US007786352B2

(12) United States Patent
Moloney et al.

(10) Patent No.: US 7,786,352 B2
(45) Date of Patent: Aug. 31, 2010

(54) METHODS FOR THE PRODUCTION OF APOLIPOPROTEINS IN TRANSGENIC PLANTS

(75) Inventors: Maurice M. Moloney, Calgary (CA); Alexandra Reid, Milton, CA (US); Cory Lee Nykiforuk, Calgary (CA); Joseph G. Boothe, Calgary (CA)

(73) Assignees: Sembiosys Genetics Inc., Alberta (CA); UTI Limited Partnership, Alberta (CA)

( * ) Notice: Subject to any disclaimer, the term of this patent is extended or adjusted under 35 U.S.C. 154(b) by 673 days.

(21) Appl. No.: 10/987,454

(22) Filed: Nov. 15, 2004
(Under 37 CFR 1.47)

(65) Prior Publication Data
US 2005/0172359 A1    Aug. 4, 2005

Related U.S. Application Data

(60) Provisional application No. 60/519,606, filed on Nov. 14, 2003, provisional application No. 60/579,733, filed on Jun. 16, 2004.

(51) Int. Cl.
*C12N 15/82* (2006.01)
(52) U.S. Cl. ...................................... 800/288; 800/287
(58) Field of Classification Search .................. None
See application file for complete search history.

(56) References Cited

U.S. PATENT DOCUMENTS

| | | | |
|---|---|---|---|
| 4,956,282 | A | 9/1990 | Goodman et al. |
| 5,202,422 | A | 4/1993 | Hiatt et al. |
| 5,550,038 | A | 8/1996 | Goodman et al. |
| 5,629,175 | A | 5/1997 | Goodman et al. |
| 5,639,947 | A | 6/1997 | Hiatt et al. |
| 5,650,307 | A | 7/1997 | Sijimons et al. |
| 5,650,554 | A | 7/1997 | Moloney |
| 5,716,802 | A | 2/1998 | Sijmons et al. |
| 5,763,748 | A | 6/1998 | Sijmons et al. |
| 5,948,682 | A | 9/1999 | Moloney |
| 5,959,177 | A | 9/1999 | Hein et al. |
| 6,288,304 | B1 | 9/2001 | Moloney et al. |
| 6,506,879 | B1 | 1/2003 | Ageland et al. |
| 6,750,046 | B2 | 6/2004 | Moloney et al. |
| 6,753,167 | B2 | 6/2004 | Moloney et al. |
| 2005/0039235 | A1* | 2/2005 | Moloney et al. ............ 800/288 |

OTHER PUBLICATIONS

Hood et al., Mol. Breed., 1997, vol. 3, pp. 291-306.*
Bustos et al., Plant Cell, 1989, vol. 1, pp. 839-853.*
Jean Bergeron et al., "Characterization of human apolipoprotein A-I expressed in *Escherichia coli*", Biochimica et Biophysica Acta 1344 (1997) 139-152.
Kenneth Emancipator et al., "In Vitro Inactivation of Bacterial Endotoxin by Human Lipoproteins and Apolipoproteins", Infection and Immunity, vol. 60, No. 2, Feb. 1992, pp. 596-601.
T.M. Forte et al., "Physical and chemical characteristics of apolipoprotein A-I-lipid complexes produced by Chinese hamster ovary cells transfected with the human apoliproprotein A-I gene", Biochimica et Biophysica Acta. 1047 (1990) 11-18.
Guido Franceschini et al., "A-I$_{Milano}$ Apoprotein—Decreased High Density Lipoprotein Cholesterol Levels with Significant Lipoprotein Modifications and Without Clinical Atherosclerosis in an Italian Family", J. Clin. Invest. The American Society for Clinical Investigations, Inc. vol. 66, Nov. 1980 pp. 892-900.
Jeffrey I. Gordon et al., "Proteolytic Processing of Human Preproapolipoprotein A-I", The Journal of Biological Chemistry, vol. 258, No. 6, Mar. 25, 1983, pp. 4037-4044.
Hui-hua Li et al., "Preparation and Incorporation of Probe-Labeled apoA-I for fluorescence resonance energy transfer studies of rHDL", Journal of Lipid Research vol. 42, 2001, pp. 2084-8091.
Joanne Bednarz Mallory et al., "Expression and Characterization of Human Apolipoprotein A-I in Chinese Hamster Ovary Cells", The Journal of Biological Chemistry, vol. 262, No. 9, Mar. 25, 1987, pp. 4241-4247.
Robert O. Ryan et al., "Optimized Bacterial Expression of Human Apolipoprotein A-I" Protein Expression and Purification, vol. 27, pp. 98-103.
K. Saku et al., "In vivo kinetics of human apolipoprotien A-I variants in rabbits", European Journal of Clinical Investigation, (1999) 29, pp. 196-203.
Hartmut H.-J. Schmidt et al., "Expression and Purification of Recombinant Human Apolipoprotein A-1 in Chinese Hamster Ovary Cells", Protein Expression and Purification 10, pp. 226-236 (1997).
Mary G. Sorci-Thomas et al., "High level secretion of wild type and mutant forms of human proapoA-I using baculovirus-mediated Sf-9 cell expression", Journal of Lipid Research, vol. 37, 1996, pp. 673-683.
M.T. Valente et al., "In Planta Expression of a Human Apolipoprotein", Proceedings of the XLVIII Italian Society of Agricultural Genetics—SIFV-SIGA Joint Meeting, Lecce, Italy, Sep. 2004.

(Continued)

*Primary Examiner*—Ashwin Mehta
(74) *Attorney, Agent, or Firm*—Stephen A. Bent; Foley & Lardner LLP

(57) ABSTRACT

Methods for the production of an apolipoprotein in plants are described. In one embodiment, the present invention provides a method for the expression of apolipoprotein in plants comprising:
  (a) providing a chimeric nucleic acid construct comprising in the 5' to 3' direction of transcription as operably linked components:
    (i) a nucleic acid sequence capable of controlling expression in plant cells; and
    (ii) a nucleic acid sequence encoding an apolipoprotein polypeptide;
  (b) introducing the chimeric nucleic acid construct into a plant cell; and
growing the plant cell into a mature plant capable of setting seed wherein the seed expresses apolipoprotein.

16 Claims, 54 Drawing Sheets

OTHER PUBLICATIONS

Karl H. Weisgraber et al., "Apolipoprotein A-I$_{Milano}$ Detection of Normal A-I in Affected Subjects and Evidence for a Cysteine for Arginine Substitution in the Variant A-I", The Journal of Biological Chemistry, vol. 258, No. 4, Feb. 25, 1983, pp. 2508-2513.

Kirsten Arnvig McGuire et al., "High yield overexpression and characterization of human recombinant proapolipoprotein A-I", Journal of Lipid Research vol. 37, 1996, pp. 1519-1528.

Sviridov, et al. "Deletion of the Propeptide of Apolipoprotein A-I Reduces Protein Expression but Stimulates Effective Conversion of Preβ-high Density Lipoprotein to α-high Density Lipoprotein", Journal of Lipid Research 2000, vol. 41, pp. 1872-1882.

Moguilevsky, et al. "Production of Human Recombinant Proapolipoprotein A-I in *Escherichia coli*: Purification and Biochemical Characterization" DNA, 1989, pp. 429-436, vol. 8, No. 6, Mary Ann Liebert, Inc., Publishers.

* cited by examiner

FIGURE 1(A)

```
1    atgaaagctgcggtgctgaccttggccgtgctcttcctgacggggagccaggctcggcat    60
1     M   K   A   A   V   L   T   L   A   V   L   F   L   T   G   S   Q   A   R   H    20

61   ttctggcagcaagatgaaccccccagagccctgggatcgagtgaaggacctggccact    120
21    F   W   Q   Q   D   E   P   P   Q   S   P   W   D   R   V   K   D   L   A   T    40

121  gtgtacgtggatgtgctcaaagacagcggcagagactatgtgtcccagtttgaaggctcc    180
41    V   Y   V   D   V   L   K   D   S   G   R   D   Y   V   S   Q   F   E   G   S    60

181  gccttgggaaaacagctaaacctaaagctccttgacaactgggacagcgtgacctccacc    240
61    A   L   G   K   Q   L   N   L   K   L   L   D   N   W   D   S   V   T   S   T    80

241  ttcagcaagctgcgcgaacagctcggccctgtgacccaggagttctgggataacctggaa    300
81    F   S   K   L   R   E   Q   L   G   P   V   T   Q   E   F   W   D   N   L   E    100

301  aaggagacagagggcctgaggcaggagatgagcaaggatctggaggaggtgaaggccaag    360
101   K   E   T   E   G   L   R   Q   E   M   S   K   D   L   E   E   V   K   A   K    120

361  gtgcagccctacctggacgacttccagaagaagtggcaggaggagatggagctctaccgc    420
121   V   Q   P   Y   L   D   D   F   Q   K   K   W   Q   E   E   M   E   L   Y   R    140

421  cagaaggtggagccgctgcgcgcagagctccaagagggcgcgcgccagaagctgcacgag    480
141   Q   K   V   E   P   L   R   A   E   L   Q   E   G   A   R   Q   K   L   H   E    160

481  ctgcaagagaagctgagcccactgggcgaggagatgcgcgaccgcgcgcgcgcccatgtg    540
161   L   Q   E   K   L   S   P   L   G   E   E   M   R   D   R   A   R   A   H   V    180

541  gacgcgctgcgcacgcatctggccccctacagcgacgagctgcgccagcgcttggccgcg    600
181   D   A   L   R   T   H   L   A   P   Y   S   D   E   L   R   Q   R   L   A   A    200

601  cgccttgaggctctcaaggagaacggcggcgccagactggccgagtaccacgccaaggcc    660
201   R   L   E   A   L   K   E   N   G   G   A   R   L   A   E   Y   H   A   K   A    220

661  accgagcatctgagcacgctcagcgagaaggccaagcccgcgctcgaggacctccgccaa    720
221   T   E   H   L   S   T   L   S   E   K   A   K   P   A   L   E   D   L   R   Q    240

721  ggcctgctgcccgtgctggagagcttcaaggtcagcttcctgagcgctctcgaggagtac    780
241   G   L   L   P   V   L   E   S   F   K   V   S   F   L   S   A   L   E   E   Y    260

781  actaagaagctcaacacccagtga
261   T   K   K   L   N   T   Q   *
```

FIGURE 1(B)

```
1   gatgaaccccccagagcccctgggatcgagtgaaggacctggccactgtgtacgtggat   60
1    D  E  P  P  Q  S  P  W  D  R  V  K  D  L  A  T  V  Y  V  D    20

61  gtgctcaaagacagcggcagagactatgtgtcccagtttgaaggctccgccttgggaaaa  120
21   V  L  K  D  S  G  R  D  Y  V  S  Q  F  E  G  S  A  L  G  K    40

121 cagctaaacctaaagctccttgacaactgggacagcgtgacctccaccttcagcaagctg  180
41   Q  L  N  L  K  L  L  D  N  W  D  S  V  T  S  T  F  S  K  L    60

181 cgcgaacagctcggccctgtgacccaggagttctgggataacctggaaaaggagacagag  240
61   R  E  Q  L  G  P  V  T  Q  E  F  W  D  N  L  E  K  E  T  E    80

241 ggcctgaggcaggagatgagcaaggatctggaggaggtgaaggccaaggtgcagccctac  300
81   G  L  R  Q  E  M  S  K  D  L  E  E  V  K  A  K  V  Q  P  Y   100

301 ctggacgacttccagaagaagtggcaggaggagatggagctctaccgccagaaggtggag  360
101  L  D  D  F  Q  K  K  W  Q  E  E  M  E  L  Y  R  Q  K  V  E   120

361 ccgctgcgcgcagagctccaagagggcgcgcgccagaagctgcacgagctgcaagagaag  420
121  P  L  R  A  E  L  Q  E  G  A  R  Q  K  L  H  E  L  Q  E  K   140

421 ctgagcccactgggcgaggagatgcgcgacgcgcgcgcccatgtggacgcgctgcgca    480
141  L  S  P  L  G  E  E  M  R  D  A  R  A  H  V  D  A  L  R     160

481 cgcatctggccccctacagcgacgagctgcgccagtgcttggccgcgcgccttgaggctc  540
161  T  H  L  A  P  Y  S  D  E  L  R  Q  C  L  A  A  R  L  E  A   180

541 tcaaggagaacggcggcgccagactggccgagtaccacgccaaggccaccgagcatctga  600
181  L  K  E  N  G  G  A  R  L  A  E  Y  H  A  K  A  T  E  H  L   200

601 gcacgctcagcgagaaggccaagcccgcgctcgaggacctccgccaaggcctgctgcccg  660
201  S  T  L  S  E  K  A  K  P  A  L  E  D  L  R  Q  G  L  L  P   220

661 tgctggagagcttcaaggtcagcttcctgagcgctctcgaggagtacactaagaagctca  720
221  V  L  E  S  F  K  V  S  F  L  S  A  L  E  E  Y  T  K  K  L   240

721 acacccagtga
241  N  T  Q  *
```

FIGURE 1(C)

```
1    gatgaaccccccagagcccctgggatcgagtgaaggacctggccactgtgtacgtggat    60
1     D   E   P   P   Q   S   P   W   D   R   V   K   D   L   A   T   V   Y   V   D    20

61   gtgctcaaagacagcggcagagactatgtgtcccagtttgaaggctccgccttgggaaaa   120
21    V   L   K   D   S   G   R   D   Y   V   S   Q   F   E   G   S   A   L   G   K    40

121  cagctaaacctaaagctccttgacaactgggacagcgtgacctccaccttcagcaagctg   180
41    Q   L   N   L   K   L   L   D   N   W   D   S   V   T   S   T   F   S   K   L    60

181  cgcgaacagctcggccctgtgacccaggagttctgggataacctggaaaaggagacagag   240
61    R   E   Q   L   G   P   V   T   Q   E   F   W   D   N   L   E   K   E   T   E    80

241  ggcctgaggcaggagatgagcaaggatctggaggaggtgaaggccaaggtgcagccctac   300
81    G   L   R   Q   E   M   S   K   D   L   E   E   V   K   A   K   V   Q   P   Y   100

301  ctggacgacttccagaagaagtggcaggaggagatggagctctaccgccagaaggtggag   360
101   L   D   D   F   Q   K   K   W   Q   E   E   M   E   L   Y   R   Q   K   V   E   120

361  ccgctgcgcgcagagctccaagagggcgcgcgccagaagctgcacgagctgcaagagaag   420
121   P   L   R   A   E   L   Q   E   G   A   R   Q   K   L   H   E   L   Q   E   K   140

421  ctgagcccactgggcgaggagatgcgcgacgcgcgcgcgcccatgtggacgcgctgcgca   480
141   L   S   P   L   G   E   E   M   R   D   C   A   R   A   H   V   D   A   L   R   160

481  cgcatctggcccccctacagcgacgagctgcgccagtcgctggccgcgcgccttgaggctc   540
161   T   H   L   A   P   Y   S   D   E   L   R   Q   R   L   A   A   R   L   E   A   180

541  tcaaggagaacggcggcgccagactggccgagtaccacgccaaggccaccgagcatctga   600
181   L   K   E   N   G   G   A   R   L   A   E   Y   H   A   K   A   T   E   H   L   200

601  gcacgctcagcgagaaggccaagcccgcgctcgaggacctccgccaaggcctgctgcccg   660
201   S   T   L   S   E   K   A   K   P   A   L   E   D   L   R   Q   G   L   L   P   220

661  tgctggagagcttcaaggtcagcttcctgagcgctctcgaggagtacactaagaagctca   720
221   V   L   E   S   F   K   V   S   F   L   S   A   L   E   E   Y   T   K   K   L   240

721  acacccagtga
241   N   T   Q   *
```

FIGURE 16
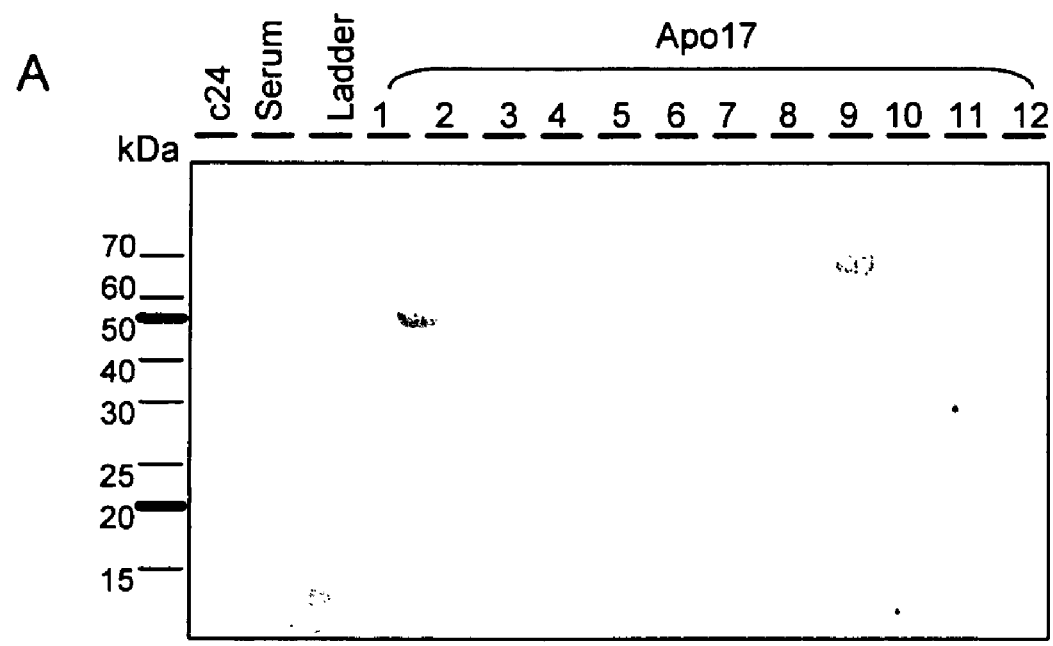
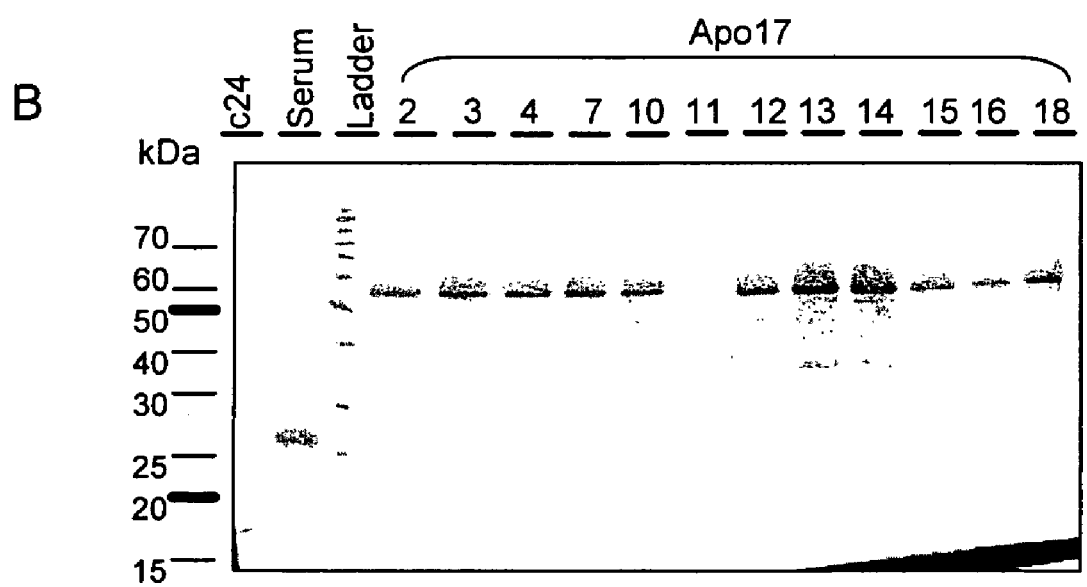

FIGURE 17
A
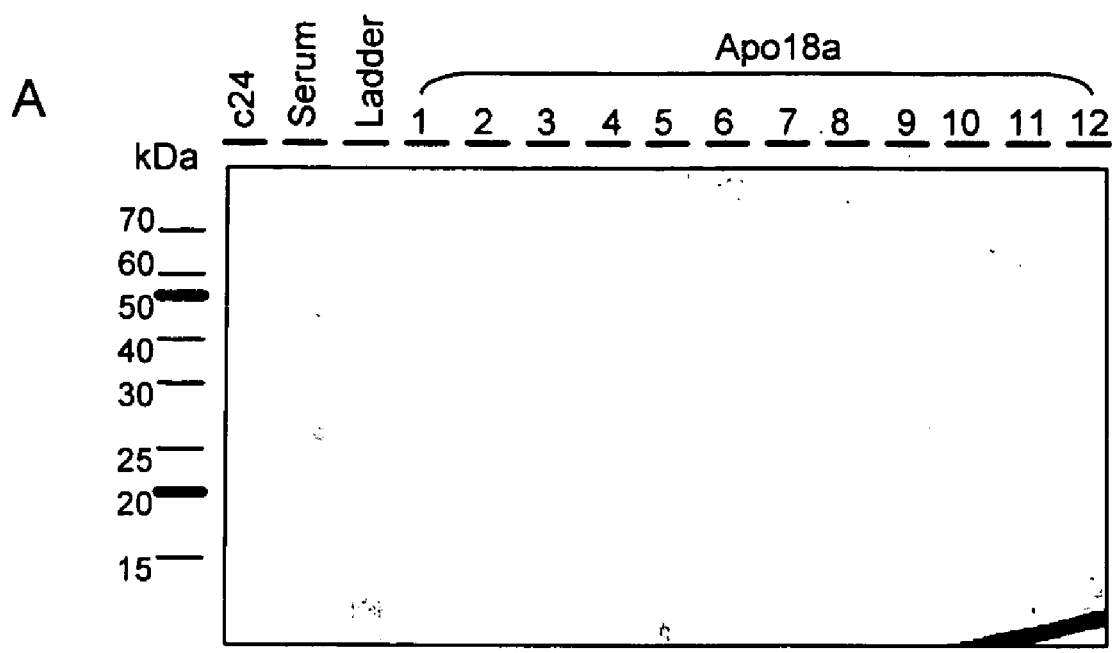
B
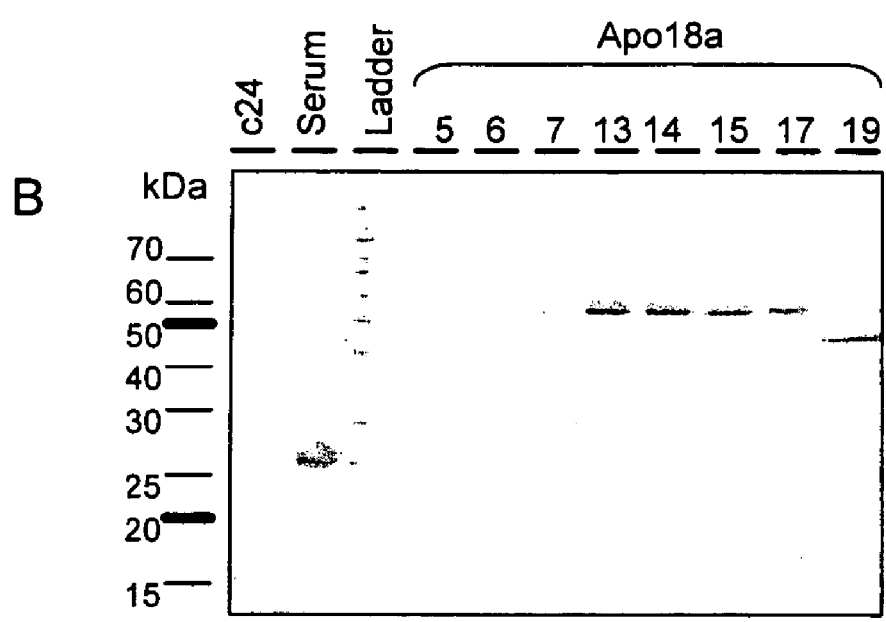

FIGURE 18
A
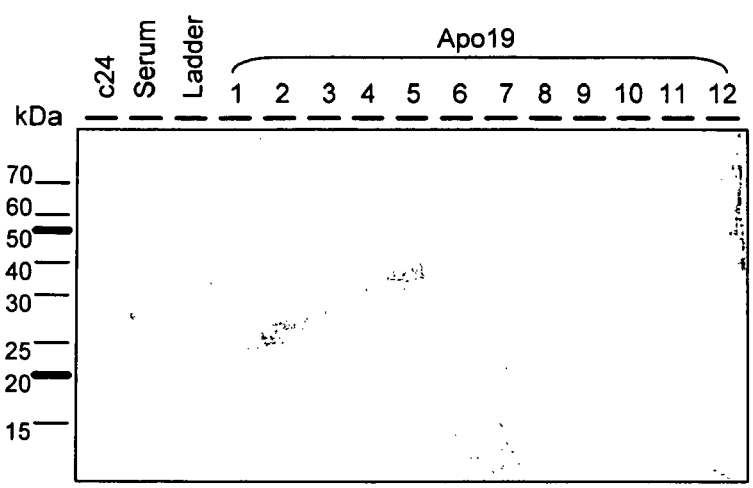
B
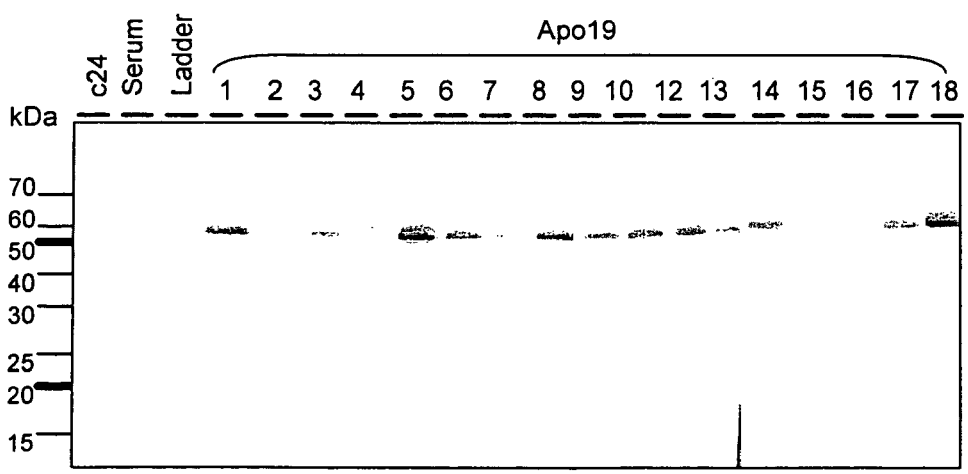

FIGURE 20
A
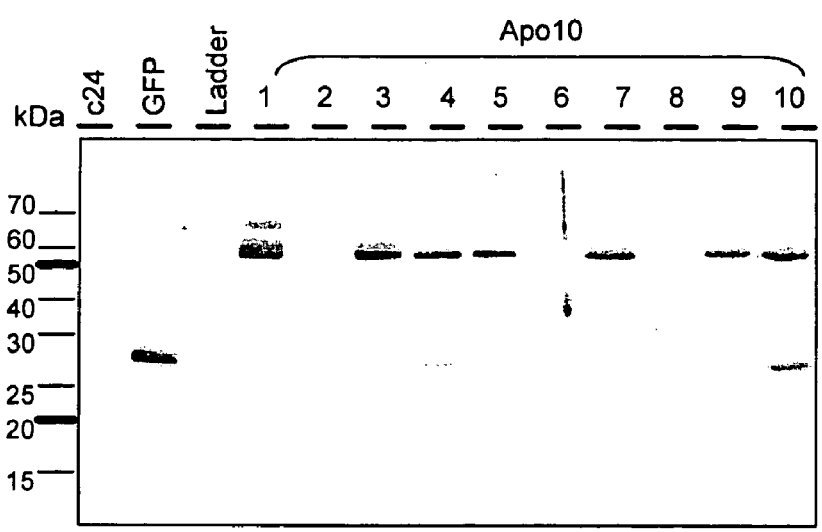
B
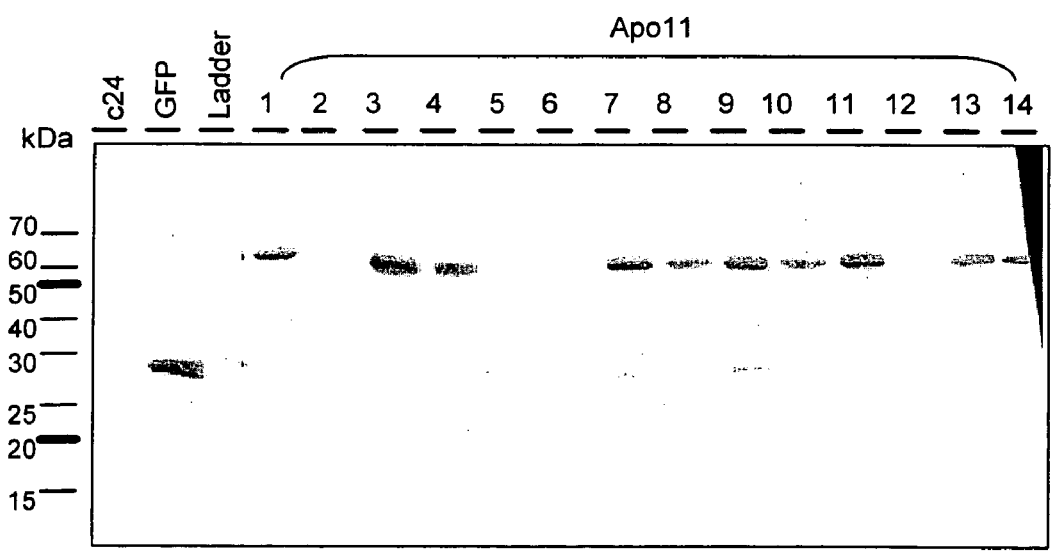

FIGURE 21
A
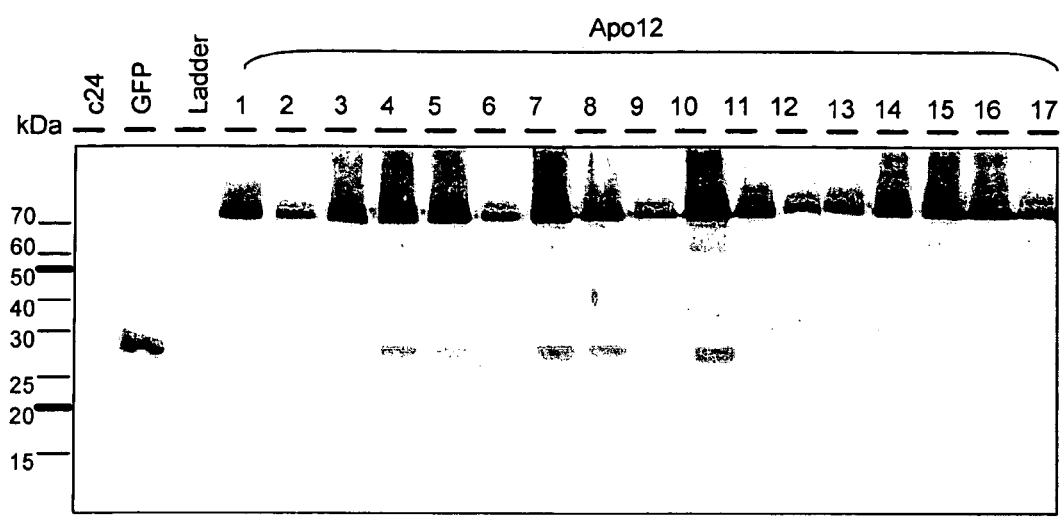
B
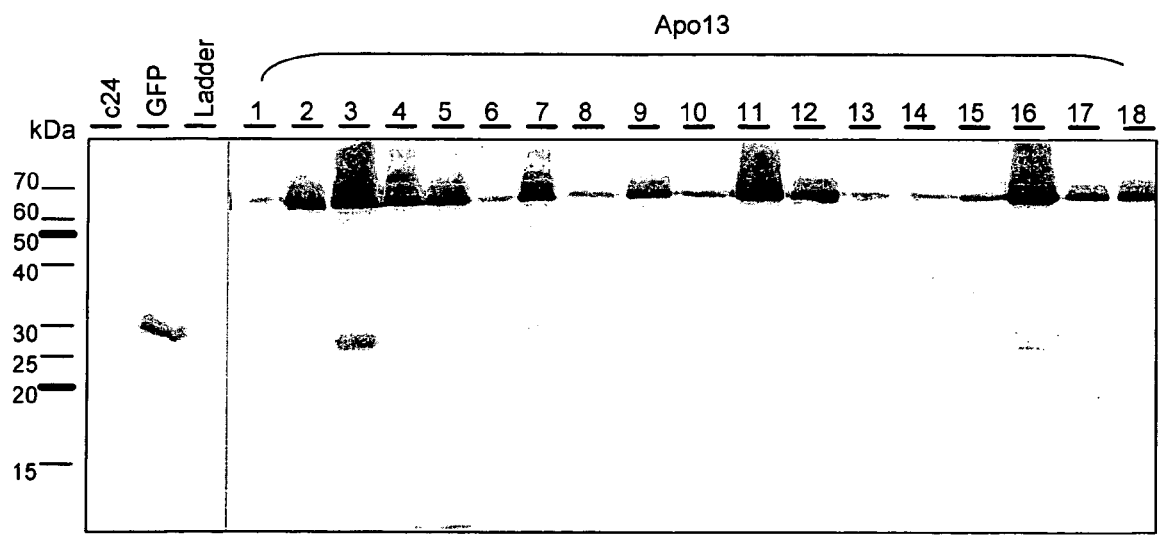

FIGURE 22
A
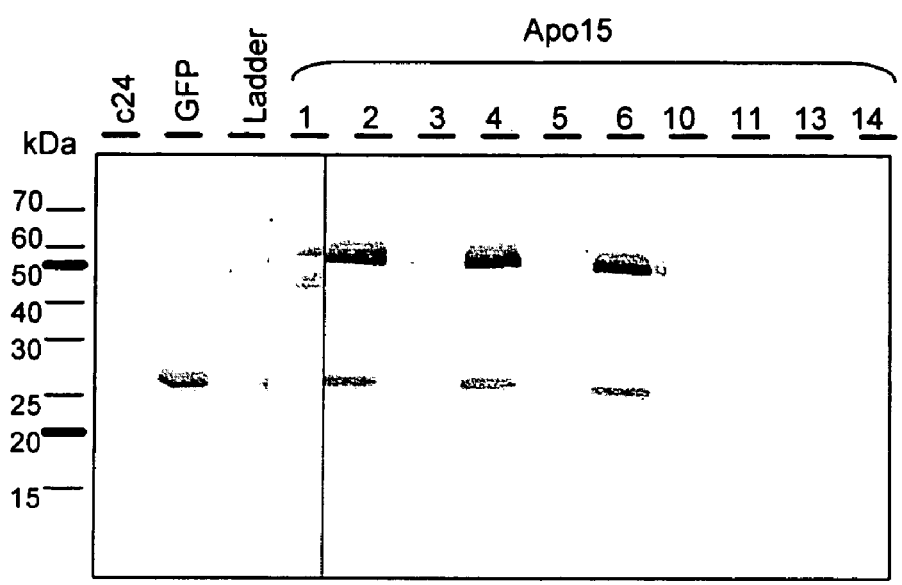
B
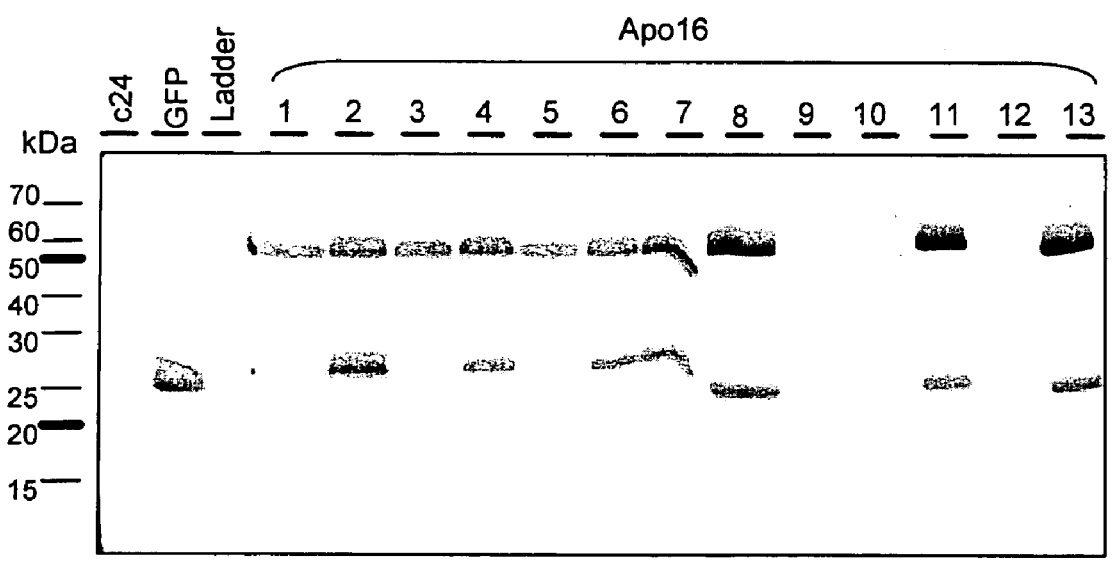

FIGURE 23
A
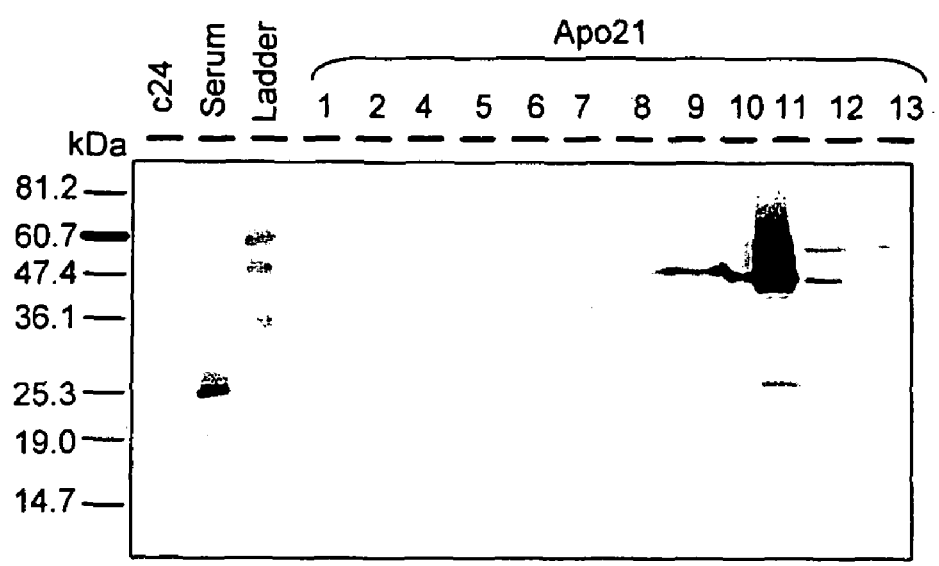
B
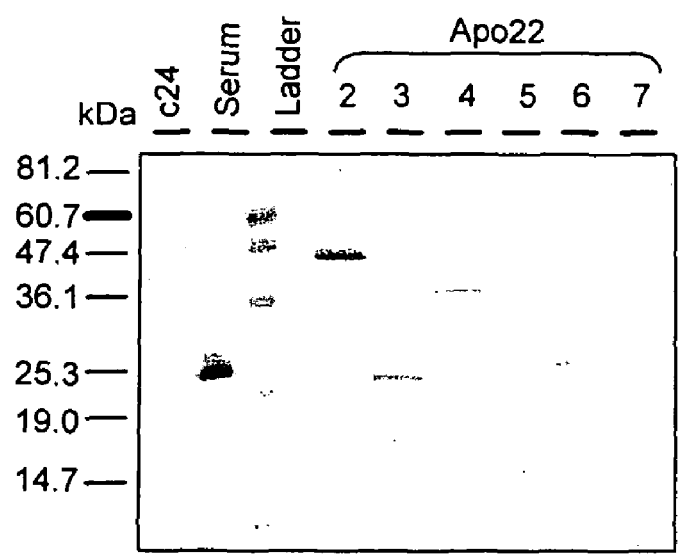

FIGURE 24
A
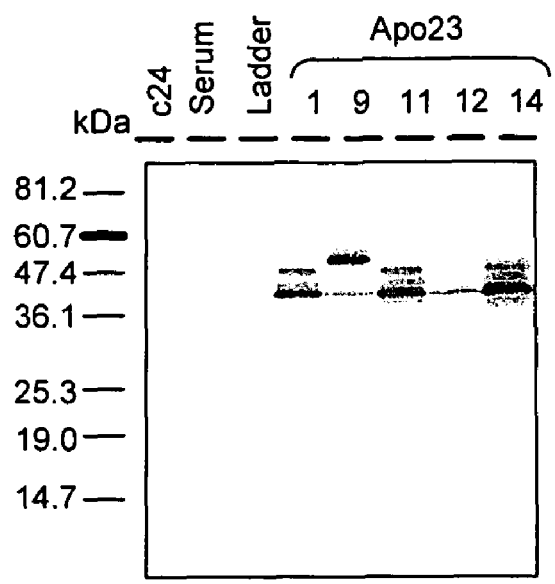
B
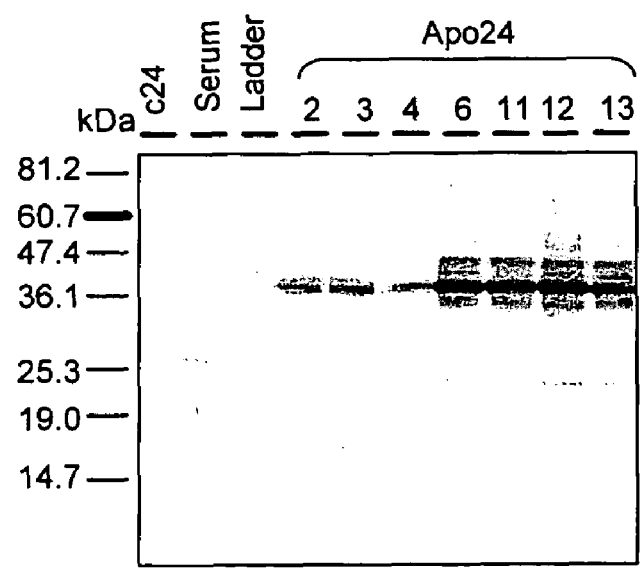

FIGURE 25
A
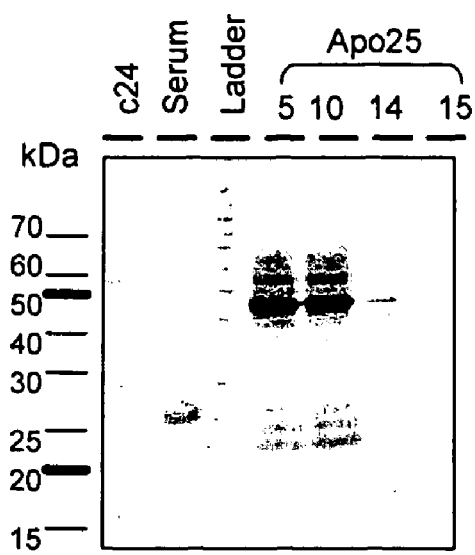
B
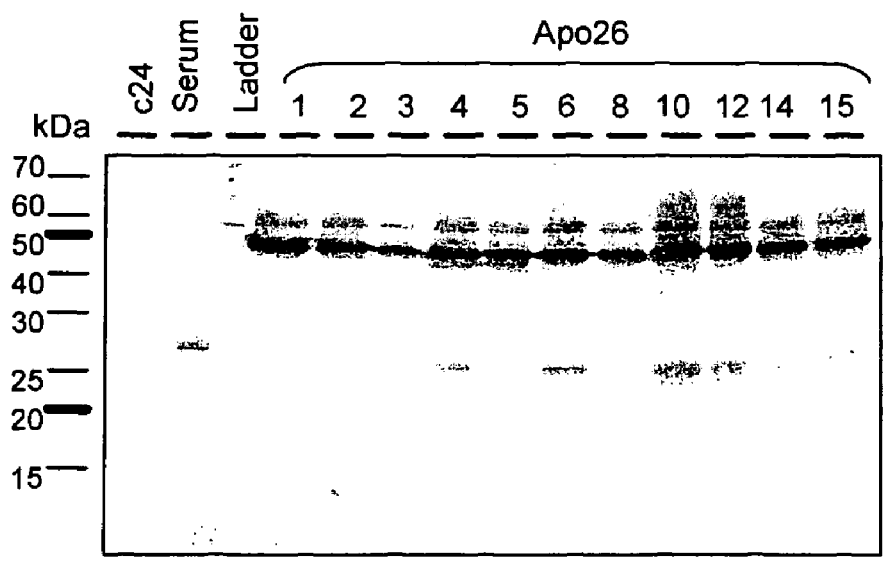

FIGURE 26
A
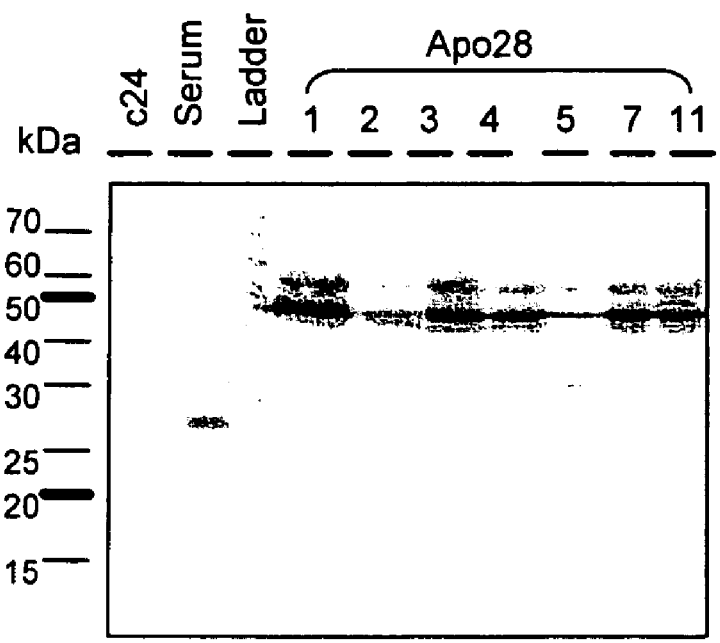
B
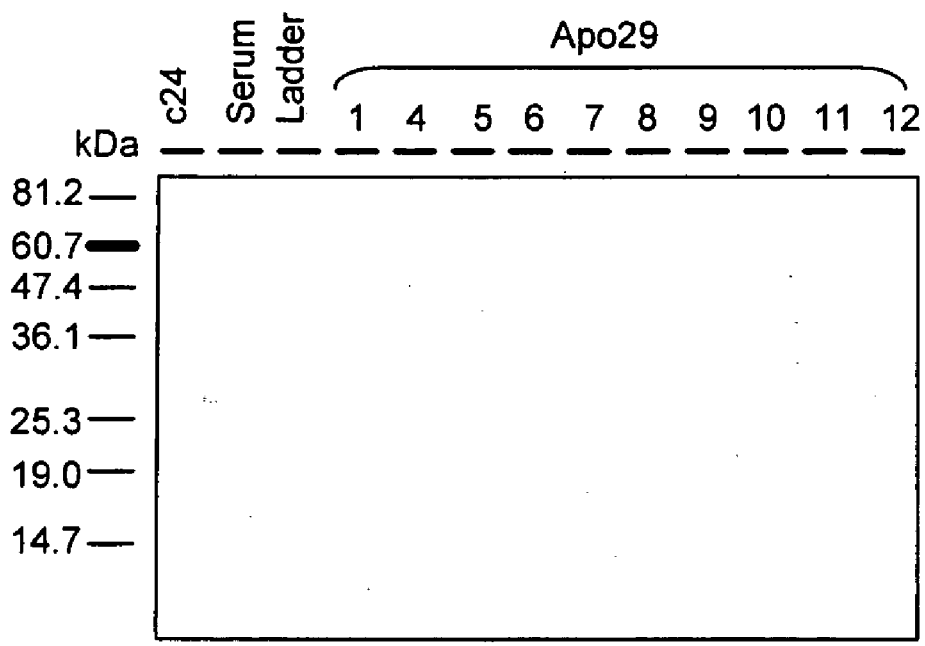

FIGURE 28
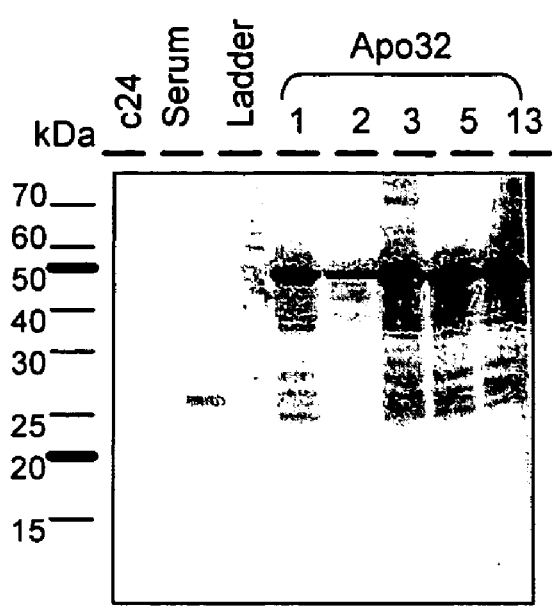
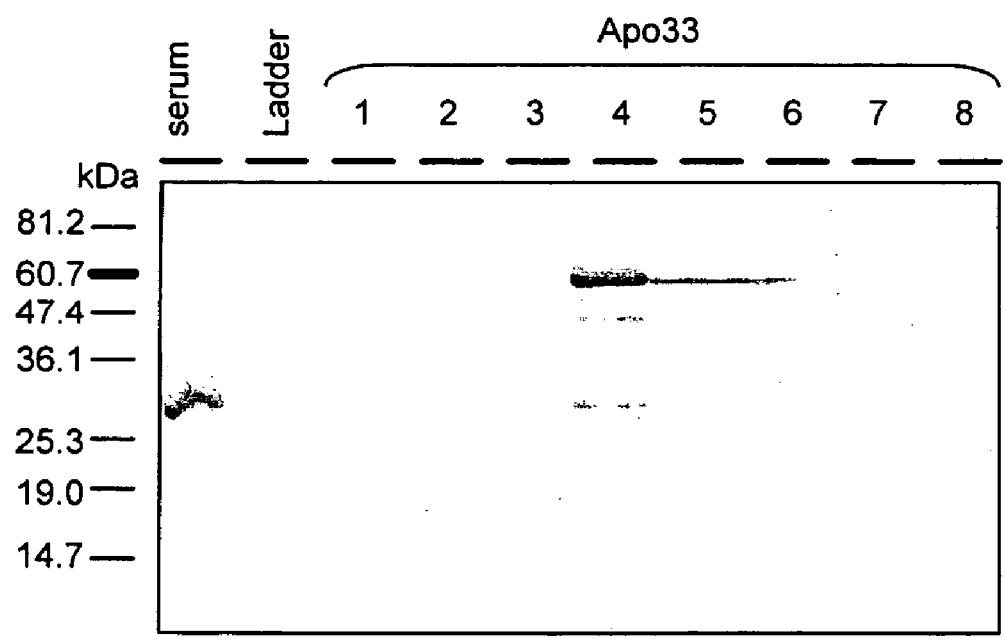

FIGURE 30
A
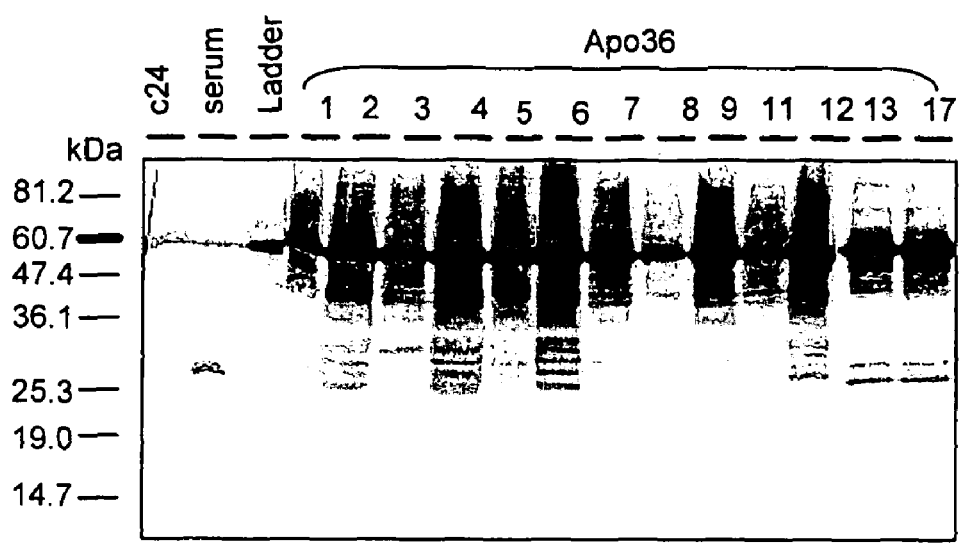
B
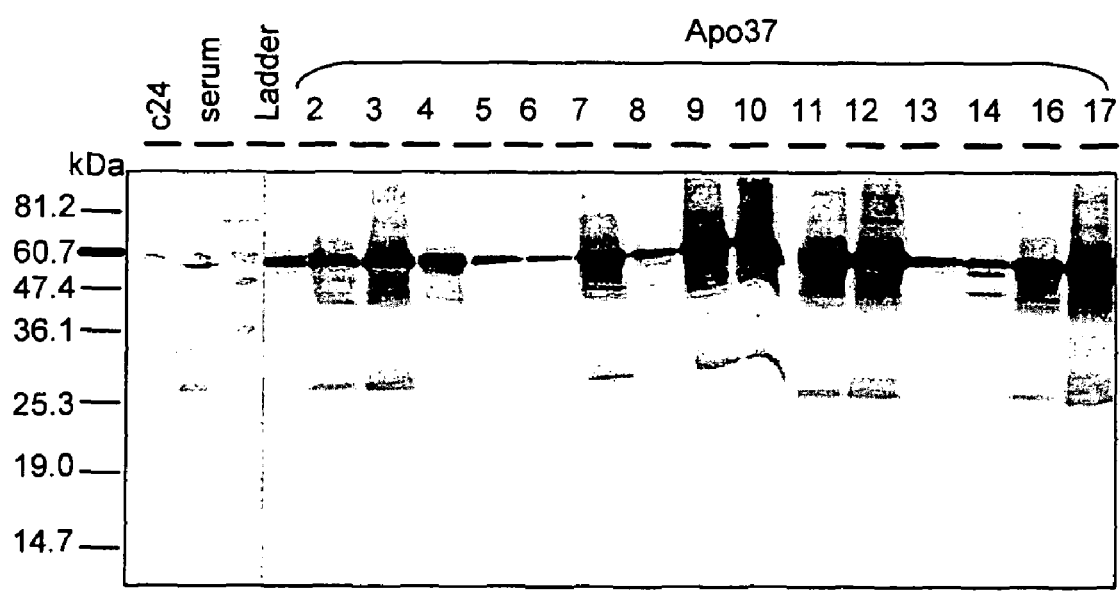

FIGURE 31
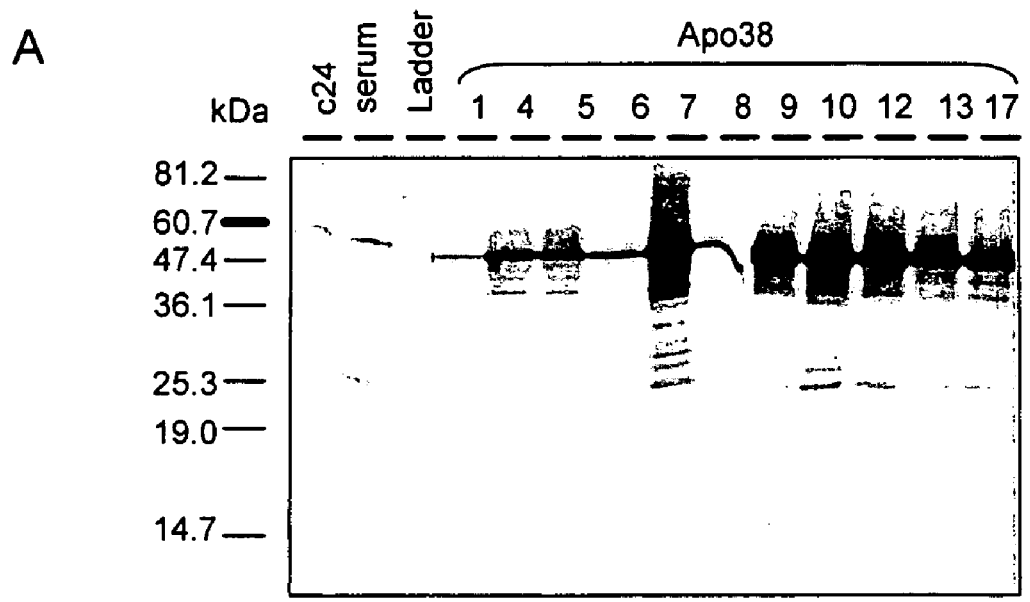
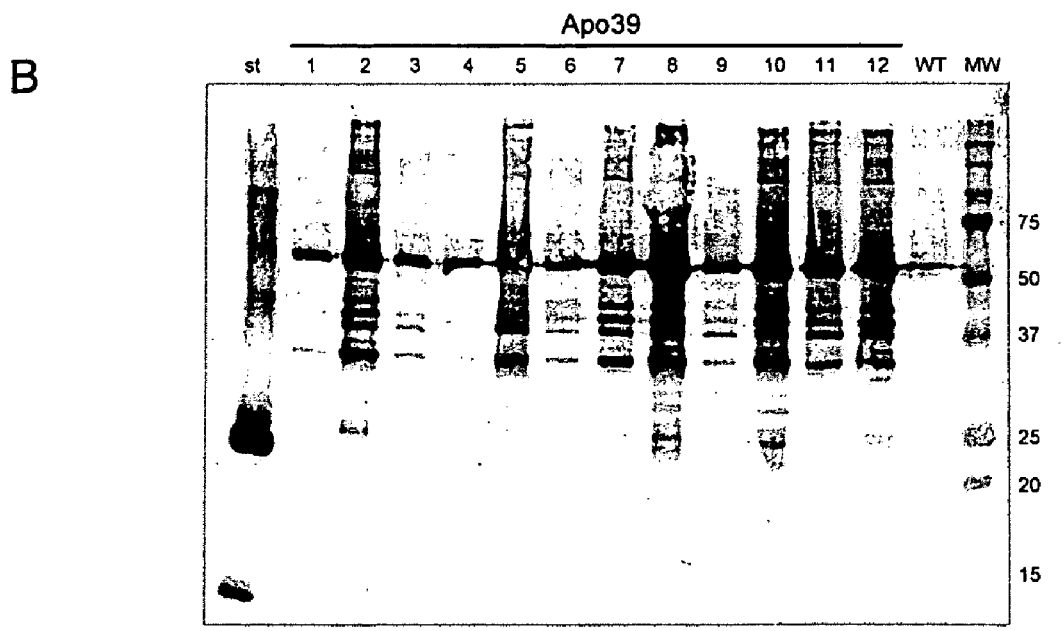

FIGURE 32
A
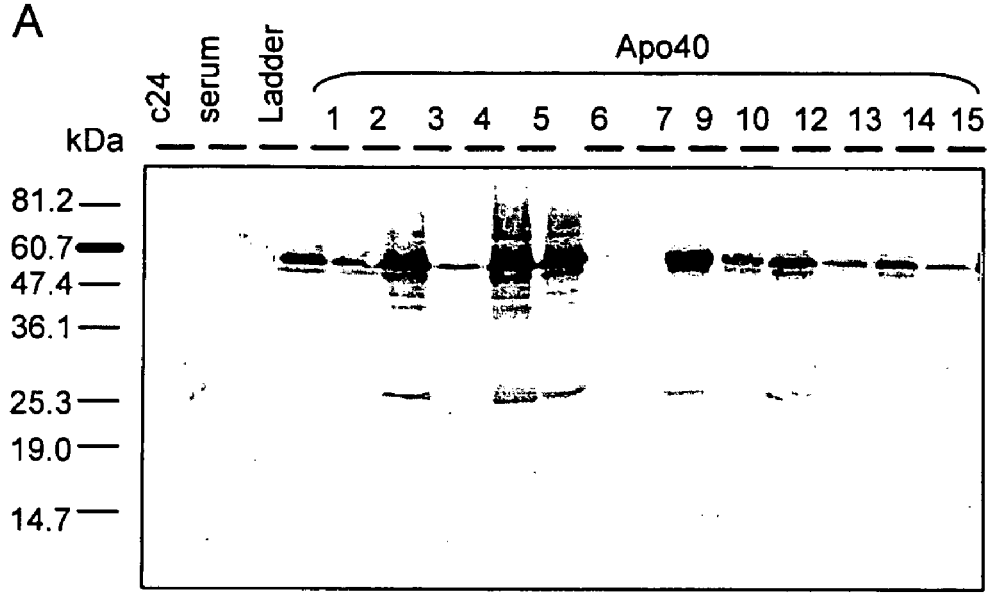
B
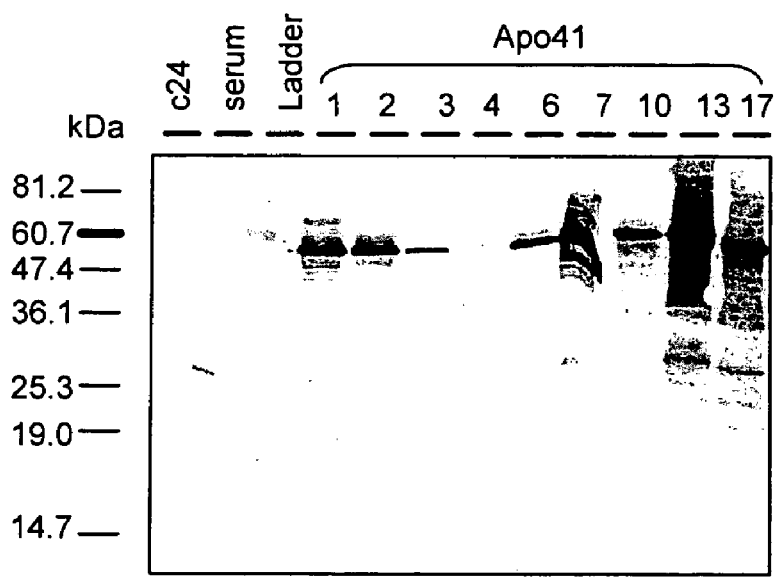

A

FIGURE 34
A
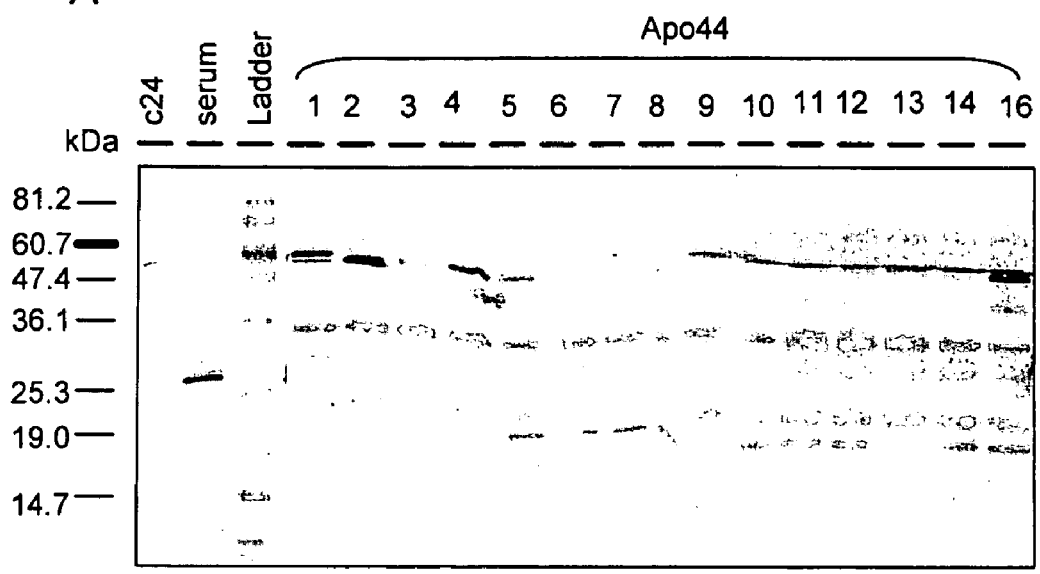
B
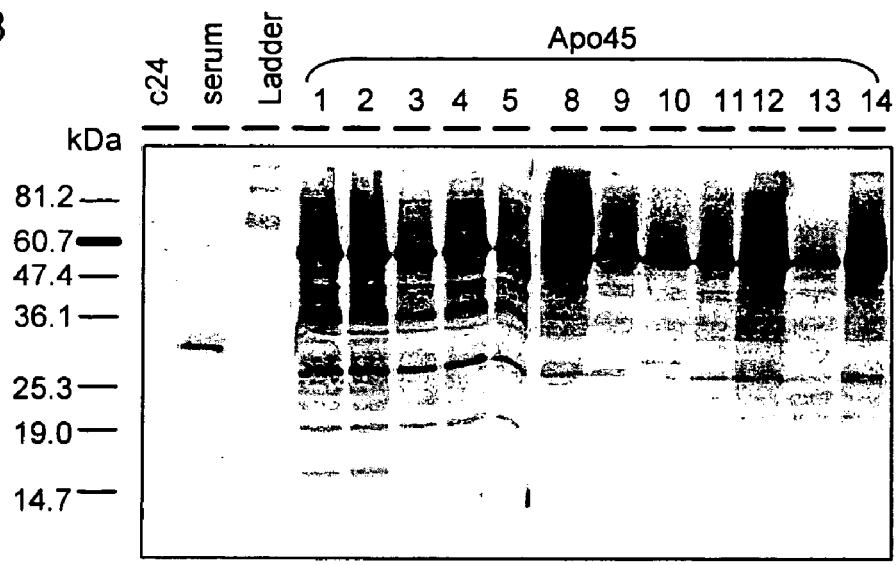

FIGURE 36
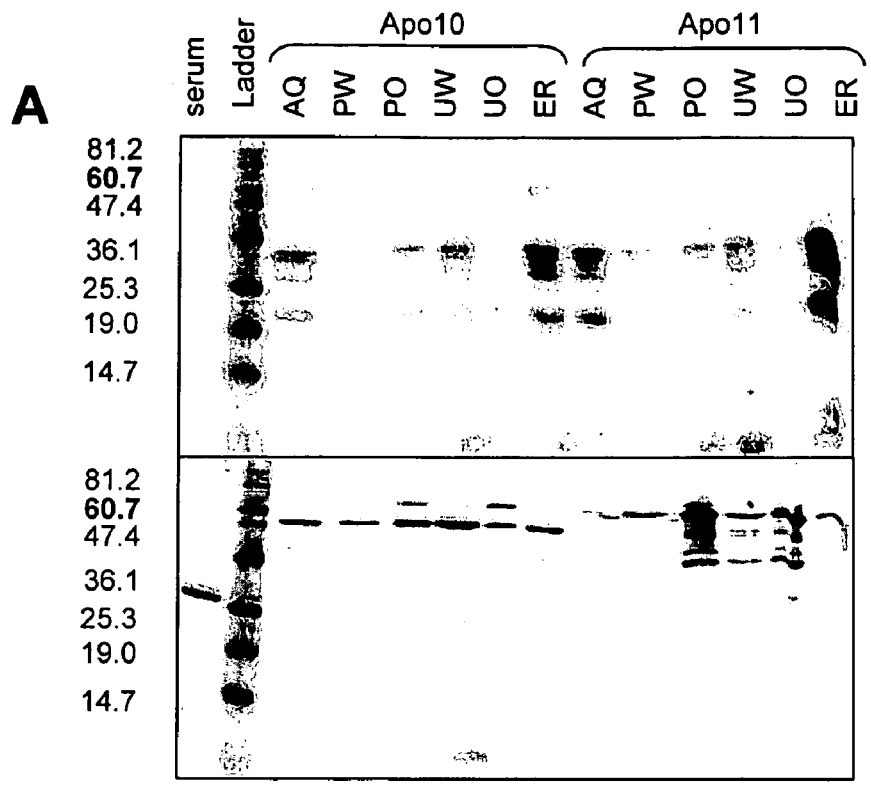
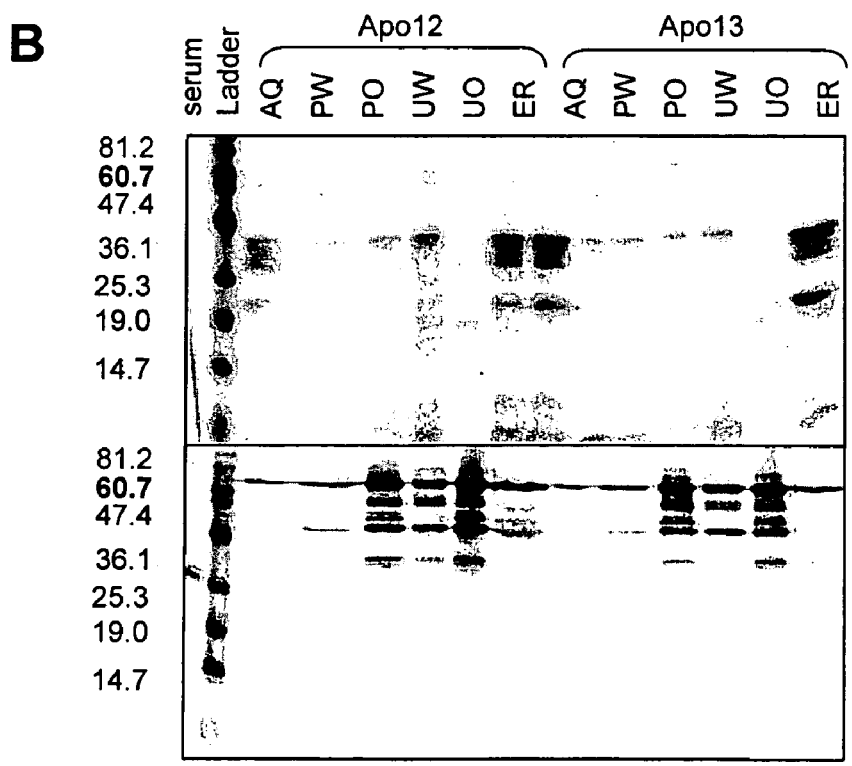

FIGURE 45
A
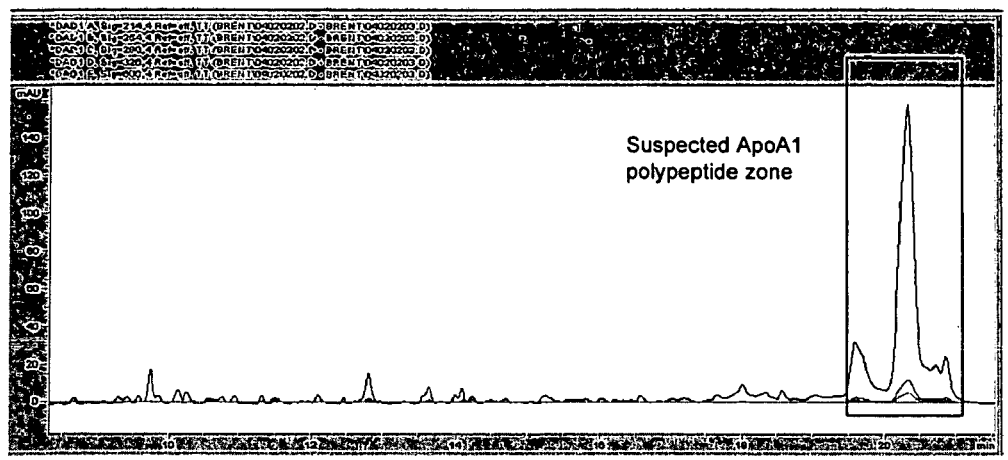
B
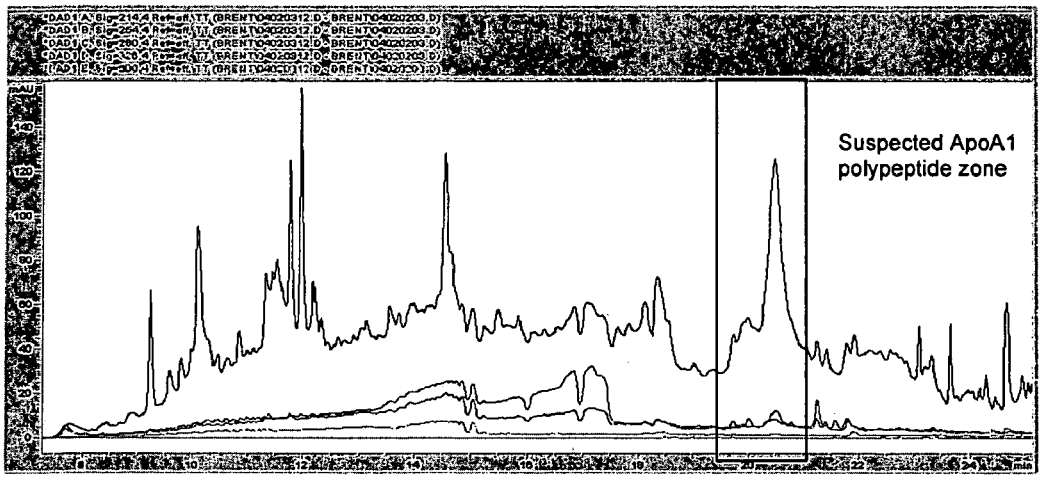

FIGURE 45
C
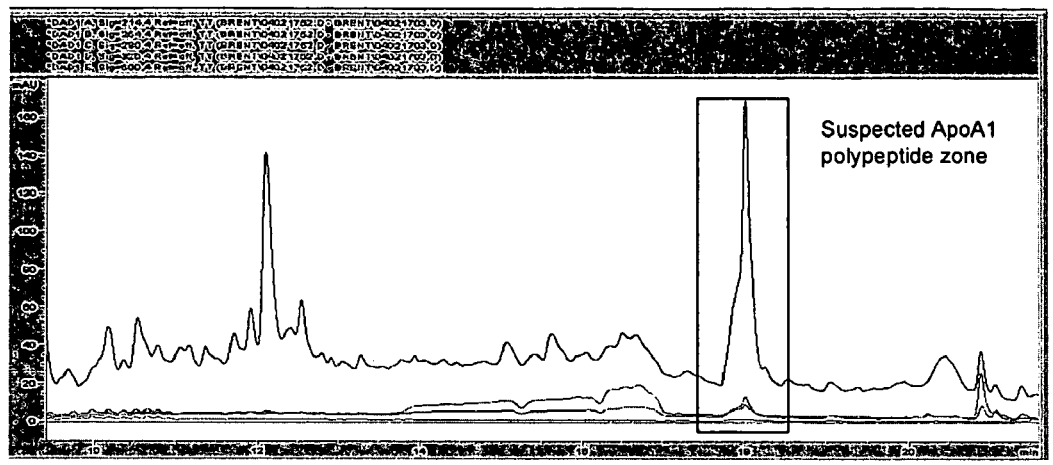
D
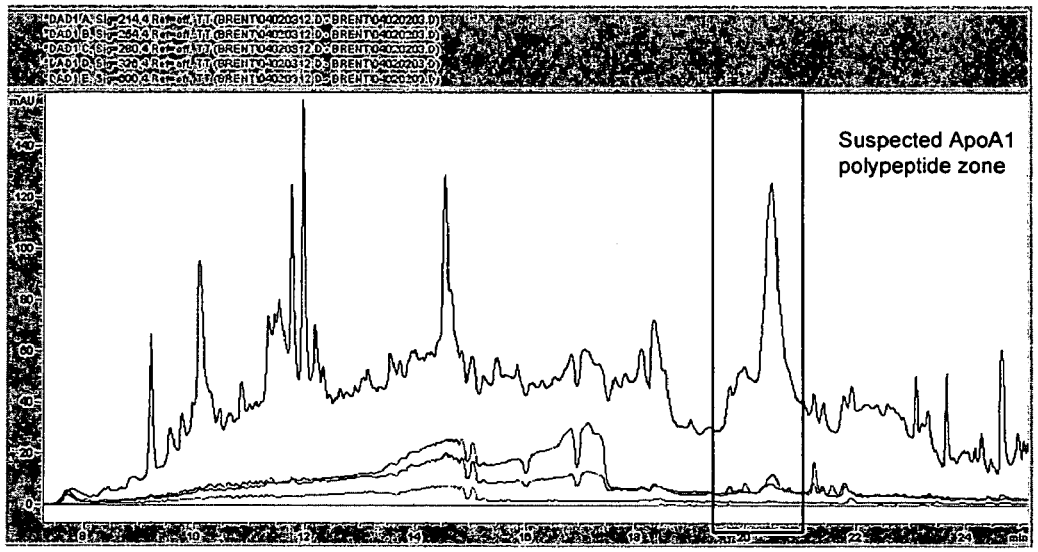

METHODS FOR THE PRODUCTION OF APOLIPOPROTEINS IN TRANSGENIC PLANTS

FIELD OF THE INVENTION

The present invention relates to plant genetic engineering methods and to the production of apolipoproteins. More specifically, the present invention relates to methods for the production of recombinant apolipoproteins in transgenic plants.

BACKGROUND OF THE INVENTION

In a healthy human body, there is a balance between the delivery and removal of cholesterol. When people have a high level of low-density lipoprotein (LDL) and low level of high-density lipoprotein (HDL), the imbalance results in more cholesterol being deposited in the arteries than that being removed (van Dam, M. J. et al. 2002, Lancet 359: 37-42)). Atherosclerosis, the narrowing or blocking of arteries, is a consequence of the repeated deposit of cholesterol, termed plaque (Major, A. S. et al. 2001, Arterioscler. Thromb. Vasc. Biol. 21: 1790-1795)).

Lipoproteins can be separated into atherogenetic and vasoprotective lipoproteins. Atherogenetic lipoproteins are generally all apolipoprotein (Apo) B-containing lipoprotein such as very-low-density lipoprotein (VLDL), intermediate (IDL), low (LDL) or lipoprotein (Lp(a)), whereas vasoprotective lipoproteins are Apo AI containing, such as HDL.

Apo AI, the major protein constituent of HDL, plays a critical role in cholesterol homeostasis. Clinical and population-based studies have demonstrated a remarkable inverse correlation between cardiovascular disease and plasma HDL levels, suggesting Apo AI and HDL help to serve a protective role against atherogenesis (Rubins, H. B. et al. 1993, Am. J. Cartiol. 71: 45-52)). Studies of transgenic mice (Rubin, E. M. et al. 1991, Nature 353: 265-267)) and rabbits (Duverger, N. et al. 1996, Circulation 94: 713-717)) susceptible to atherosclerosis have shown that expression of human Apo AI inhibits the development of atherosclerosis. This effect may be related to its efficient promotion of cholesterol efflux from cells (Castro, G. et al. 1997, Biochemistry 36: 2243-2249)), the first step in the process of 'reverse cholesterol transport' (RCT) (Glomset, J. A. 1968, J Lipid Res. 9: 155-167)). Apo AI modulates this process by being a preferential acceptor of cellular cholesterol (Rothblat, G. H. et al. 1999, J Lipid Res. 40: 781-796)), increasing the activity of lecithin-cholesterol-acyl-transferase (LCAT) esterification of HDL-associated cholesterol several-fold (Jonas, A. 1991, Biochim. Biophys. Acta 1084: 205-220; Mahley, R. W. et al. 1984, J Lipid Res. 25: 1277-1294)), and transporting LCAT-derived cholesteryl esters to the liver (Morrison, J. R. et al. 1992, J. Biol. Chem. 267: 13205-13209)).

Unlike synthetic antihyperlipidemics, such as LIPITOR® (atorvastatin calcium) that act to lower lipid levels in the body by inhibiting the synthesis of cholesterol (Alaupovic, P. et al. 1997, Atherosclerosis 133: 123-133)), an infusion of purified Apo AI stimulates cholesterol efflux from tissues into plasma (Navab, M. et al. 2002, Circulation 105: 290-292)). This suggests that Apo AI could stimulate cholesterol efflux from foam cells in the arterial wall and induce regression of atherosclerotic plaque, effectively 'cleaning out' the arteries.

In humans, Apo AI is synthesized in liver and intestinal cells as a non-glycosylated pre-pro-protein (Gordon, J. I. et al. 1983, J. Biol. Chem. 258: 4037-4044)). The 18 amino acid pre-segment is removed before the protein leaves the cell and the 6 amino acid pro-segment is cleaved post secretion by an unknown protease in the plasma, leaving the mature 243 amino acid protein (Saku, K. et al. 1999, Eur. J. Clin. Invest. 29: 196-203)).

The Apolipoprotein A-I$_{Milano}$ (Apo AI-M) is the first described molecular variant of human Apo AI (Franceschini, G. et al. 1980, J. Clin. Invest. 66: 892-900)). It is characterized by the substitution of Arg 173 with Cys (Weisgraber, K. H. et al. 1983, J. Biol. Chem. 258: 2508-2513)). The mutant apolipoprotein is transmitted as an autosomal dominant trait and 8 generations of carriers have been identified (Gerli, G. C. et al. 1984, Hum. Hered. 34: 133-140)).

The status of the Apo AI-M carrier individual is characterized by a remarkable reduction in HDL-cholesterol level. In spite of this, the affected subjects do not apparently show any increased risk of arterial disease; indeed, by examination of the genealogic tree it appears that these subjects may be "protected" from atherosclerosis.

The mechanism of the possible protective effect of Apo AI-M in the carriers seems to be linked to a modification in the structure of the mutant apolipoprotein, with the loss of one alpha-helix and an increased exposure of hydrophobic residues (Franceschini, G. et al. 1985, J. Biol. Chem. 260: 16321-16325). The loss of the tight structure of the multiple alpha-helices leads to an increased flexibility of the molecule, which associates more readily with lipids, compared to normal A-I. Moreover, apolipoprotein/lipid complexes are more susceptible to denaturation, thus suggesting that lipid delivery is also improved in the case of the mutant.

The therapeutic use of Apo AI and the Apo AI-M mutant is presently limited by the lack of a method allowing the preparation of said apolipoproteins in sufficient amount and in a suitable form. In particular, the recombinant production of Apo AI has been shown to be very difficult due to its amphiphilic character, autoaggregation, and degradation (Schmidt, H. H. et al. 1997, Protein Expr. Purif. 10: 226-236). At the time of the present invention, recombinant human Apo AI has been expressed in vitro in two eukaryotic systems: Baculovirus transfected *Spodoptera frugiperda* (Sf9) cells (Sorci-Thomas, M. G. et al. 1996, J. Lipid Res. 37: 673-683) and stably transfected Chinese hamster ovary (CHO) cells (Forte, T. M. et al. 1990, Biochim. Biophys. Acta 1047: 11-18; Mallory, J. B. et al. 1987, J. Biol. Chem. 262: 4241-4247). In the baculovirus system, once the cells are successfully transfected, there is an in-depth screening process before cells with the correct construct can be used for expression. Similarly, CHO cell colonies must undergo a screening process to find stably transfected, high expressing colonies. Additionally, both of these cell types require a relatively long period of time before significant expression is achieved and a much higher level of maintenance than bacteria.

Recombinant expression of proteins in bacterial systems is generally attractive because it can produce large amounts of pure protein quickly and economically There are several reports of Apo AI expression in transformed *Escherichia coli* (*E. coli*); however, while certain recent improvements in expression levels have been made (Ryan, R. O. et al. 2003, Protein Expr. Purif. 27: 98-103) in general, these methods provide relatively low yields or the undesirable presence of extraneous affinity tags or secretion signals (Bergeron, J. et al. 1997, Biochim. Biophys. Acta 1344: 139-152; L1, H. H. et al. 2001, J. Lipid Res. 42: 2084-2091; McGuire, K. A. et al. 1996, J. Lipid Res. 37: 1519-1528). Moreover, *E. coli* endotoxins are known to form particularly strong complexes with apolipoproteins (Emancipator et al. (1992) Infect. Immun. 60: 596-601). Reduction or elimination of the toxicity associated with these *E. coli* endotoxins in pharmaceutical preparations of apoliproteins is highly desirable. The removal of these endotoxins, while technically feasible, involves complex and expensive protein purification methodologies (U.S. Pat. No. 6,506,879) without fully eliminating the human health risk.

The use of plants as bioreactors for the large scale production of recombinant proteins is known to the art, and numerous proteins, including human therapeutic proteins, have been produced. For example, U.S. Pat. Nos. 4,956,282, 5,550,038 and 5,629,175 disclose the production of γ-interferon in plants; U.S. Pat. Nos. 5,650,307, 5,716,802 and 5,763,748 detail the production of human serum albumin in plants and U.S. Pat. Nos. 5,202,422, 5,639,947 and 5,959,177 relate to the production of antibodies in plants. One of the significant advantages offered by plant-based recombinant protein production systems is that by increasing the acreage of plants grown, protein production can be inexpensively scaled up to provide for large quantities of protein. By contrast, fermentation and cell culture systems have large space, equipment and energy requirements, rendering scale-up of production costly. However, despite the fact that the use of plants as bioreactors is amply documented, and despite the above mentioned therapeutic applications of apolipoproteins, the prior art provides no methods for the production of apolipoproteins in plants.

In order to offer a practical alternative to the fermentation and cell culture based systems, it is important that plants remain healthy and that apolipoproteins accumulate to significant levels in the plants. In view of the inherent property of apolipoproteins to associate with lipids, recombinantly expressed apolipoproteins may associate with the endogenous plant lipids and thereby interfere with the plant's lipid metabolism. Thus recombinant expression of apolipoproteins may affect the health of the plant. Alternatively, the recombinantly expressed apolipoprotein may fail to accumulate to effective levels, as protective mechanisms may result in degradration of the apolipoprotein. It thus is unclear whether and how the synthetic capacity of plants may be harnessed to achieve the commercial production of apolipoproteins in plants.

Thus in view of the shortcomings associated with the methods for the recombinant production of apolipoproteins by the prior art, there is a need in the art to improve methods for the production of apolipoproteins.

SUMMARY OF THE INVENTION

The present invention relates to methods for the production of apolipoprotein in plants. In particular the present invention relates to methods for the production of apolipoprotein in plant seeds.

Accordingly, the present invention provides a method for the expression of an apolipoprotein in plants comprising:
  (a) providing a chimeric nucleic acid construct comprising in the 5' to 3' direction of transcription as operably linked components:
    (i) a nucleic acid sequence capable of controlling expression in plant cells; and
    (ii) a nucleic acid sequence encoding an apolipoprotein polypeptide;
  (b) introducing the chimeric nucleic acid construct into a plant cell; and
  (c) growing the plant cell into a mature plant capable of expressing the apolipoprotein.

In accordance with the present invention plant seeds have been found to be particularly suitable for the production of apolipoprotein. Accordingly, the present invention provides a method for expressing apolipoprotein in plant seeds comprising:
  (a) providing a chimeric nucleic acid construct comprising in the 5' to 3' direction of transcription as operably linked components:
    (i) a nucleic acid sequence capable of controlling expression in plant seed cells; and
    (ii) a nucleic acid sequence encoding an apolipoprotein polypeptide;
  (b) introducing the chimeric nucleic acid construct into a plant cell; and
  (c) growing the plant cell into a mature plant capable of setting seed wherein the seed expresses the apolipoprotein.

In a further preferred embodiment the nucleic acid sequence capable of controlling expression in a plant seed cell is a seed-preferred promoter, such as the phaseolin promoter. In a preferred embodiment, at least 0.25% of the total seed protein is apolipoprotein.

In preferred embodiments of the present invention the chimeric nucleic acid sequence further comprises a nucleic acid sequence encoding a stabilizing polypeptide linked in reading frame to the nucleic acid sequence encoding the apolipoprotein. Preferably the stabilizing polypeptide is a polypeptide that in the absence of the apolipoprotein can readily be expressed and stably accumulates in a plant cell. The stabilizing protein may be plant specific or non plant specific. Plant-specific stabilizing polypeptides that can be used in accordance with the present invention include oil body proteins and thioredoxins. Non-plant specific stabilizing polypeptides that may be used in accordance herewith include green fluorescent protein (GFP) and single chain antibodies or fragments thereof. The plant-specific or non-plant specific stabilizing polypeptide may be linked to the apolipoprotein via a linker which can be cleaved to release the apolipoprotein in its free native form.

The chimeric nucleic acid sequence further preferably comprise a targeting signal in such a manner that the apolipoprotein polypeptide accumulates in the endoplasmic reticulum (ER) or in association with an ER-derived storage vesicle, for example an oil body, within the plant cell. Accordingly, the chimeric nucleic acid construct additionally may comprise a nucleic acid sequence encoding a polypeptide which is capable of targeting the apolipoprotein polypeptide to the ER or an ER derived storage vesicle. Nucleic acid sequences that may be used to target the apolipoprotein to the ER include for example nucleic acid sequences encoding KDEL, HDEL, SDEL sequences. Nucleic acid sequences that may be used to target the apolipoprotein to an oil body include nucleic acid sequences encoding oil body proteins, such as oleosins. In addition, in accordance with the present invention, the apolipoprotein may be targeted to the oil body by expressing the apolipoprotein in such a manner that the apolipoprotein does not include a targeting signal, provided however, that the nucleic acid sequence encoding the apolipoprotein comprises an apolipoprotein pro-peptide.

In another preferred embodiment the chimeric nucleic acid comprises a targeting signal in such a manner that the apolipoprotein accumulates in the apoplast. Accordingly, in such an embodiment the chimeric nucleic acid construct additional preferably contains a nucleic acid sequence encoding a polypeptide which is capable of targeting the apolipoprotein polypeptide to the apoplast.

In yet a further preferred embodiment, the nucleic acid sequence encoding the apolipoprotein is expressed in such a manner that the apolipoprotein accumulates in the cytoplasm. In such an embodiment the nucleic acid sequence does not comprise a targeting signal.

In a further preferred embodiment the chimeric nucleic acid construct is introduced into the plant cell under nuclear genomic integration conditions. Under such conditions the chimeric nucleic acid sequence is stably integrated in the plant's genome.

In a yet further preferred embodiment the nucleic acid sequence encoding apolipoprotein is optimized for plant codon usage. Preferred nucleic acid sequences used in accordance with the present invention encode human, bovine or porcine Apolipoprotein A-I and pro-Apolipoprotein A-I.

In another aspect, the present invention provides a method of obtaining plant seed comprising apolipoprotein. Accordingly, pursuant to the present invention a method is provided for obtaining plant seed comprising:
 (a) providing a chimeric nucleic acid construct comprising in the 5' to 3' direction of transcription as operably linked components:
  (i) a nucleic acid sequence capable of controlling expression in plant tissue cells; and
  (ii) a nucleic acid sequence encoding an apolipoprotein polypeptide;
 (b) introducing the chimeric nucleic acid construct into a plant cell;
 (c) growing the plant cell into a mature plant capable of setting seed; and
 (d) obtaining seed from said plant wherein the seed comprises the apolipoprotein.

The seeds may be used to obtain a population of progeny plants each comprising a plurality of seeds expressing apolipoprotein. The present invention also provides plants capable of setting seed expressing apolipoprotein. In a preferred embodiment of the invention, the plants capable of setting seed comprise a chimeric nucleic acid sequence comprising in the 5' to 3' direction of transcription:
 (a) a first nucleic acid sequence capable of controlling expression in a plant cell operatively linked to;
 (b) a second nucleic acid sequence encoding an apolipoprotein polypeptide, wherein the cell contains the apolipoprotein.

In a preferred embodiment the chimeric nucleic acid sequence is integrated in the plant's nuclear genome.

In a further preferred embodiment of the present invention the plant that is used is an *Arabidopsis* plant and in a particularly preferred embodiment the plant is a safflower plant.

In yet another aspect, the present invention provides plant seeds expressing apolipoprotein. In a preferred embodiment of the present invention, the plant seeds comprise a chimeric nucleic acid sequence comprising in the 5' to 3' direction of transcription:
 (a) a first nucleic acid sequence capable of controlling expression in a plant cell operatively linked to;
 (b) a second nucleic acid sequence encoding an apolipoprotein polypeptide.

The seeds are a source whence the desired apolipoprotein polypeptide, which is synthesized by the seed cells, may be extracted and obtained in a more or less pure form. The apolipoprotein may be used to treat vascular diseases.

Other features and advantages of the present invention will become readily apparent from the following detailed description. It should be understood, however, that the detailed description and the specific examples while indicating preferred embodiments of the invention, are given by way of illustration only, since various changes and modifications within the spirit and scope of the invention will become readily apparent to those skilled in the art from this detailed description.

BRIEF DESCRIPTION OF THE DRAWINGS

The invention will now be described in relation to the drawings in which:

FIG. 1. (A) Nucleotide sequence (SEQ ID NO:1) and deduced amino acid sequence (SEQ ID NO:2) of *Homo sapiens* Apolipoprotein A-I (Apo AI) (Kindly provided by Dr. Norman Wong, Calgary Alberta) (Accession number NM_000039). Bold residues represent pre-sequence signal peptide, underlined residues indicate pro-sequence. (B) Nucleotide sequence (SEQ ID NO:3) and deduced amino acid sequence (SEQ ID NO:4) for natural variant Apo AI$_{Milano}$ (R173C). Bold/Italicized residues represents the mutated amino acid. (C) Nucleotide sequence (SEQ ID NO:5) and deduced amino acid sequence (SEQ ID NO:6) for natural variant Apo AI Paris (R151C). Bold/Italicized residues represents the mutated amino acid.

FIG. 16. Westerns of total leaf protein (A) (25 ug) and total seed protein (B) (50 ug) with polyclonal Apo AI antibody. Apo17 is ubi-mat-Apo AI-GFP construct. c24 leaf (25 ug) and seed protein (50 ug) were used as a negative control and 0.5 ug of human blood serum protein was used as a positive control.

FIG. 17. Westerns of total leaf protein (A) (25 ug) and total seed protein (B) (50 ug) with polyclonal Apo AI antibody. Apo18a is ubi-pro-Apo AI-GFP construct. c24 leaf (25 ug) and seed protein (50 ug) were used as a negative control and 0.5 ug of human blood serum protein was used as a positive control.

FIG. 18. Westerns of total leaf protein (A) (25 ug) and total seed protein (B) (50 ug) with polyclonal Apo AI antibody. Apo19 is ubi-PRS-mat-Apo AI-GFP construct. c24 leaf (25 ug) and seed protein (50 ug) were used as a negative control and 0.5 ug of human blood serum protein was used as a positive control.

FIG. 20. Westerns of total seed protein (50 ug) with polyclonal GFP antibody. (A) Apo10 is pha-mat-Apo AI-GFP construct. (B) Apo11 is pha-pro-Apo AI-GFP construct. c24 seed protein (50 ug) was used as a negative control and 200 ng of purified GFP protein was used as a positive control.

FIG. 21. Westerns of total seed protein (50 ug) with polyclonal GFP antibody. (A) Apo12 is pha-oleosin-mat-Apo AI-GFP construct. (B) Apo13 is pha-oleosin-pro-Apo AI-GFP construct. c24 seed protein (50 ug) was used as a negative control and 200 ng of purified GFP protein was used as a positive control.

FIG. 22. Westerns of total seed protein (50 ug) with polyclonal GFP antibody. (A) Apo15 is pha-PRS-mat-Apo AI-GFP construct. (B) Apo16 is pha-PRS-pro-Apo AI-GFP construct. c24 seed protein (50 ug) was used as a negative control and 200 ng of purified GFP protein was used as a positive control.

FIG. 23. Westerns of total seed protein (50 ug) with polyclonal Apo AI antibody. (A) Apo21 is pha-matApo AI. (B) Apo22 is pha-pro-Apo AI. c24 seed protein (50 ug) was used as a negative control and 0.5 ug of human blood serum protein was used as a positive control.

FIG. 24. Westerns of total seed protein (50 ug) with polyclonal Apo AI antibody. (A) Apo23 is pha-oleo-matApo AI. (B) Apo24 is pha-oleo-pro-Apo AI. c24 seed protein (50 ug) was used as a negative control and 0.5 ug of human blood serum protein was used as a positive control.

FIG. 25. Westerns of total seed protein (50 ug) with polyclonal Apo AI antibody. (A) Apo25 is pha-oleo-klip8-matApo AI(+Met). (B) Apo26 is pha-oleo-klip8-pro-Apo AI(+Met). c24 seed protein (50 ug) was used as a negative control and 0.5 ug of human blood serum protein was used as a positive control.

FIG. 26. Westerns of total seed protein (50 ug) with polyclonal Apo AI antibody. (A) Apo28 is pha-oleo-klip8-pro-Apo AI. (B) Apo29 is pha-PRS-mat-Apo AI. c24 seed protein (50 ug) was used as a negative control and 0.5 ug of human blood serum protein was used as a positive control.

FIG. 28. Westerns of total seed protein (50 ug) with polyclonal Apo AI antibody. (A) Apo32 is pha-PRS-D9 scFv-pro-Apo AI. (B) Apo33 is pha-PRS-D9 scFv-mat-Apo AI(+met). c24 seed protein (50 ug) was used as a negative control and 0.5 ug of human blood serum protein was used as a positive control.

FIG. 30. Westerns of total seed protein (50 ug) with polyclonal Apo AI antibody. (A) Apo36 is pha-PRS-D9 scFv-pro-Apo AI-KDEL. (B) Apo37 is pha-PRS-D9 scFv-mat-Apo AI(+met)-KDEL. c24 seed protein (50 ug) was used as a negative control and 0.5 ug of human blood serum protein was used as a positive control.

FIG. 31. Westerns of total seed protein (50 ug) with polyclonal Apo AI antibody. (A) Apo38 is pha-PRS-D9 scFv-pro-Apo AI(+met)-KDEL. c24 seed protein (50 ug) was used as a negative control and 0.5 ug of human blood serum protein was used as a positive control. (B) Apo 29 is pha-PRS-D9 scFv-KLIP8-Apo AI. Wild type seed was used as a negative control and 3 ug of human Apo AI from normal human plasma (US Biologicals) was used as a positive control.

FIG. 32. Westerns of total seed protein (50 ug) with polyclonal Apo AI antibody. (A) Apo40 is pha-PRS-D9 scFv-klip8-pro-Apo AI. (B) Apo41 is pha-PRS-D9 scFv-klip8-mat-Apo AI(+met). c24 seed protein (50 ug) was used as a negative control and 0.5 ug of human blood serum protein was used as a positive control.

FIG. 34. Westerns of total seed protein (50 ug) with polyclonal Apo AI antibody. (A) Apo44 is pha-PRS-D9 scFv-klip8-pro-Apo AI-KDEL. (B) Apo45 is pha-PRS-D9 scFv-klip8-mat-Apo AI(+met). c24 seed protein (50 ug) was used as a negative control and 0.5 ug of human blood serum protein was used as a positive control.

FIG. 36. Examination of untargeted and oil body targeted Apo AI-GFP association with specific cellular fractions from seeds. Western blot analysis using the polyclonal Apo AI antibody and approximately equal quantities of total protein (50 μg) isolated from the aqueous (AQ) fraction, phosphate (PW) and urea (UW) washes of oil bodies (PO and UO respectively, with approximately 20 μg of total oil bodies used) and the microsomal (ER) fraction from mature seeds. Ponceau-S staining of the immunoblot shows relative protein amounts loaded on the gel (upper panel). Human blood serum (0.5 μg) was used as a positive control for Apo AI expression. (A) Apo10 is Apo AI-GFP. Apo11 is pro-Apo AI-GFP. (B) Apo12 is oleosin-Apo AI-GFP and Apo13 is oleosin-pro-Apo AI-GFP.

FIG. 45. Purification of Apo25, Apo26 and Apo28 by reverse phase chromatography. (A) HPLC trace of ApoAI standard (B) HPLC trace of Apo25 (C) HPLC trace of Apo26 (D) HPLC trace of Apo28. Individual wavelengths used included 214, 254, 280 and 326 nm.

DETAILED DESCRIPTION OF THE INVENTION

Figure 2:
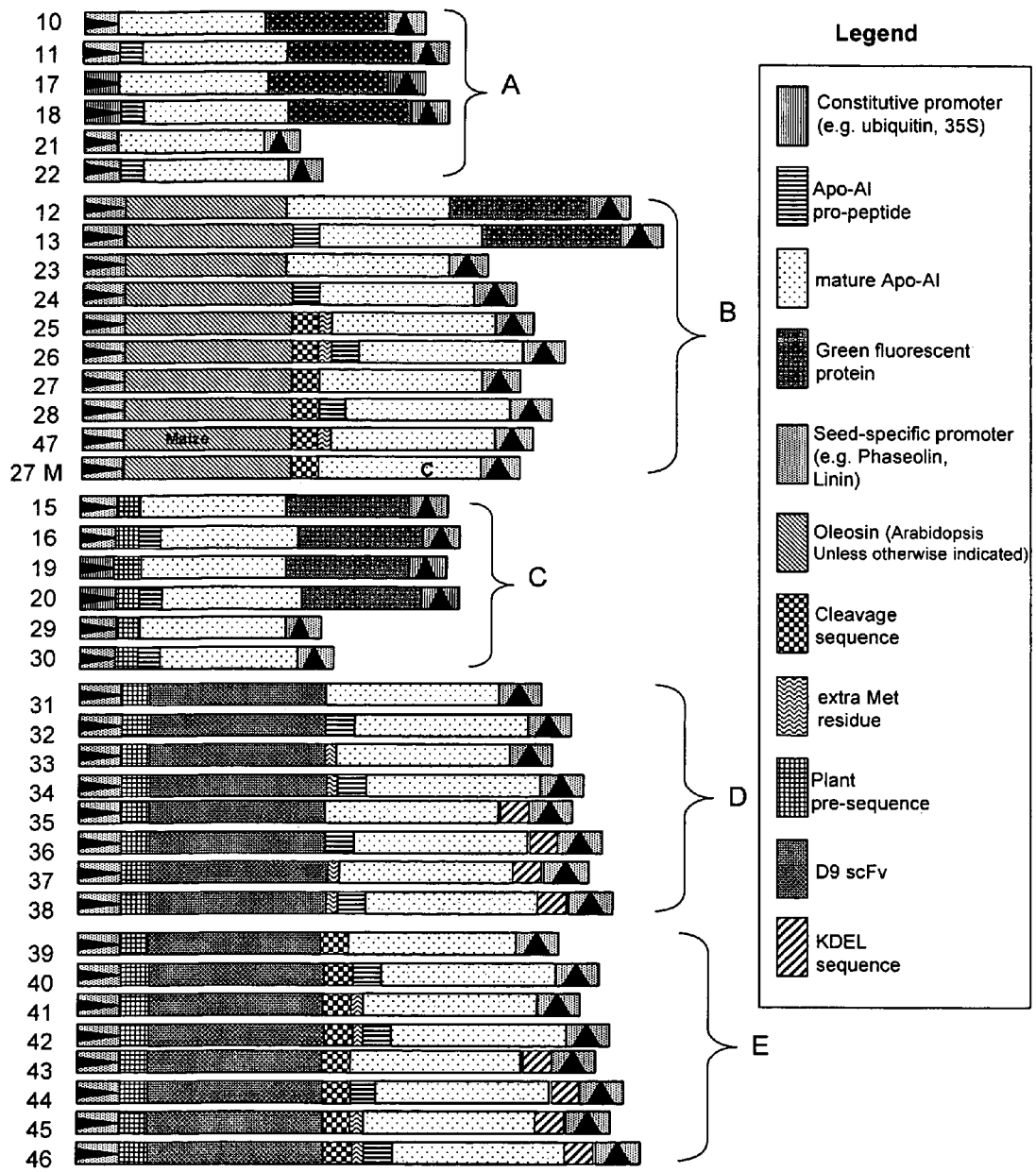
FIG. 2. Schematic drawing of all the binary constructs created for apolipoprotein Apo AI expression in *Arabidopsis* transgenic plants. (A) Constructs that are targeted to the cytosol in the plant cell. (B) Constructs that are targeted to oil bodies in the plant cell. (C-E) Constructs that are targeted to the secretory pathway. (D & E) Constructs may contain additional KDEL sequences to be retained in the endoplasmic reticulum. (D) Constructs containing the pro-sequence of Apo AI or mature Apo AI. (E) Constructs containing a cleavable sequence for the release of pro-Apo AI or mature Apo AI. Legend describes the type of promoter, signal peptide and coding sequence contained in each construct.

As hereinbefore mentioned, the present invention relates to methods for the production of apolipoprotein in transgenic plants. The present inventors have surprisingly found that production of apolipoproteins in plants is not only feasible but also offers substantial advantages over the conventional methodologies. The raw materials for plant based production are more stable, particularly as the protein is produced in plant seeds, and, moreover, are free of bacterial endotoxins. Thus the present invention provides a safe source material for the manufacture of apolipoproteins. It has also been discovered that recombinant expression of apolipoprotein can yield the native apolipoprotein in more or less pure form at levels that permits commercial scale manufacture of apolipoproteins. Accordingly, pursuant to the present invention a method for the expression of a nucleic acid sequence encoding apolipoprotein in plants is provided in which the method comprises:

(a) providing a chimeric nucleic acid construct comprising in the 5' to 3' direction of transcription as operably linked components:
  (i) a nucleic acid sequence capable of controlling expression in plant cells; and
  (ii) a nucleic acid sequence encoding an apolipoprotein polypeptide
(b) introducing the chimeric nucleic acid construct into a plant cell; and
(c) growing the plant cell into a mature plant expressing apolipoprotein.

The present inventors have found that high levels of apolipoprotein expression may be achieved by expressing the recombinant protein in plant seeds. Accordingly, the present invention provides a method for expressing apolipoprotein in plant seeds comprising:

(a) providing a chimeric nucleic acid construct comprising in the 5' to 3' direction of transcription as operably linked components:
  (i) a nucleic acid sequence capable of controlling expression in plant seed cells; and
  (ii) a nucleic acid sequence encoding an apolipoprotein polypeptide;
(b) introducing the chimeric nucleic acid construct into a plant cell; and
(c) growing the plant cell into a mature plant capable of setting seed wherein the seed expresses the apolipoprotein.

Terms and Definitions

Unless defined otherwise, all technical and scientific terms used herein shall have the same meaning as is commonly understood by one skilled in the art to which the present invention belongs. Where permitted, all patents, applications, published applications, and other publications, including nucleic acid and polypeptide sequences from GenBank, SwissPro and other databases referred to in the disclosure are incorporated by reference in their entirety.

The term "nucleic acid sequence" as used herein refers to a sequence of nucleoside or nucleotide monomers consisting of naturally occurring bases, sugars and intersugar (backbone) linkages. The term also includes modified or substituted sequences comprising non-naturally occurring monomers or portions thereof. The nucleic acid sequences of the present invention may be deoxyribonucleic acid sequences (DNA) or ribonucleic acid sequences (RNA) and may include naturally occurring bases including adenine, guanine, cytosine, thymidine and uracil. The sequences may also contain modified bases. Examples of such modified bases include aza and deaza adenine, guanine, cytosine, thymidine and uracil; and xanthine and hypoxanthine.

The terms "nucleic acid sequence encoding apolipoprotein" and "nucleic acid sequence encoding an apolipoprotein polypeptide", which may be used interchangeably herein, refer to any and all nucleic acid sequences encoding an apolipoprotein polypeptide, including any mammalian apolipoprotein polypeptide and any nucleic acid sequences that encode pro-apolipoprotein and pre-pro-apolipoprotein. As used herein "pro-apolipoprotein" refers to an apolipoprotein polypeptide which includes a polypeptide which is cleaved post-translationally. In native human apolipoprotein the propeptide is a 6 amino acid residue polypeptide chain. The term "pre-pro-apolipoprotein" refers to a pro-apolipoprotein molecule additionally comprising an N-terminal signal sequence which facilitates intracellular transport of the polypeptide chain. Nucleic acid sequences encoding an apolipoprotein polypeptide further include any and all nucleic acid sequences which (i) encode polypeptides that are substantially identical to the apolipoprotein polypeptide sequences set forth herein; or (ii) hybridize to any apolipoprotein nucleic acid sequences set forth herein under at least moderately stringent hybridization conditions or which would hybridize thereto under at least moderately stringent conditions but for the use of synonymous codons.

By the term "substantially identical" it is meant that two polypeptide sequences preferably are at least 70% identical, and more preferably are at least 85% identical and most preferably at least 95% identical, for example 96%, 97%, 98% or 99% identical. In order to determine the percentage of identity between two polypeptide sequences the amino acid sequences of such two sequences are aligned, using for example the alignment method of Needleman and Wunsch (J. Mol. Biol., 1970, 48: 443), as revised by Smith and Waterman (Adv. Appl. Math., 1981, 2: 482) so that the highest order match is obtained between the two sequences and the number of identical amino acids is determined between the two sequences. Methods to calculate the percentage identity between two amino acid sequences are generally art recognized and include, for example, those described by Carillo and Lipton (SIAM J. Applied Math., 1988, 48: 1073) and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (Devereux et al., Nucleic Acids Res., 1984, 12: 387) BLASTP, BLASTN and FASTA (Altschul et al., J. Molec. Biol., 1990: 215: 403). A particularly preferred method for determining the percentage identity between two polypeptides involves the Clustal W algorithm (Thompson, J D, Higgines, D G and Gibson T J, 1994, Nucleic Acid Res 22(22): 4673-4680 together with the BLOSUM 62 scoring matrix (Henikoff S & Henikoff, J G, 1992, Proc. Natl. Acad. Sci. USA 89: 10915-10919 using a gap opening penalty of 10 and a gap extension penalty of 0.1, so that the highest order match obtained between two sequences wherein at least 50% of the total length of one of the two sequences is involved in the alignment.

By "At least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the $T_m$, which in sodium containing buffers is a function of the sodium ion concentration and temperature ($T_m=81.5°$ C.$-16.6$ ($Log_{10}$ [$Na^+$])$+0.41$(% (G+C)$-600/1$), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in $T_m$, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5× Denhardt's solution/1.0% SDS at $T_m$ (based on the above equation)$-5°$ C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Current Protocols in Molecular Biology, John Wiley & Sons, N.Y., 1989, 6.3.1.-6.3.6 and in: Sambrook et al., Molecular Cloning, a Laboratory Manual, Cold Spring Harbor Laboratory Press, 1989, Vol. 3.

As used herein the terms "apolipoprotein" and "apolipoprotein polypeptide" refer to any and all polypeptide sequences of an apolipoprotein including all mammalian apolipoprotein polypeptides and a polypeptide comprising a sequence of amino acid residues which is (i) substantially identical to the amino acid sequences constituting any apolipoprotein polypeptides set forth herein or (ii) encoded by a nucleic acid sequence capable of hybridizing under at least moderately stringent conditions to any nucleic acid sequence encoding apolipoprotein set forth herein or capable of hybridizing under at least moderately stringent conditions to any nucleic acid sequence encoding apolipoprotein set forth herein but for the use of synonymous codons. The terms apolipoprotein and apolipoprotein polypeptide include proapolipoprotein polypeptides. The apolipoprotein polypeptide is preferably of human, porcine or bovine origin. In a preferred embodiments these apolipoproteins include, but are not limited to, Apolipoprotein A-I (Apo AI), Apolipoprotein A-IV (Apo AIV), Apolipoprotein A-V (Apo AV) and Apolipoprotein E (Apo E).

The term "chimeric" as used herein in the context of nucleic acid sequences refers to at least two linked nucleic acid sequences which are not naturally linked. Chimeric nucleic acid sequences include linked nucleic acid sequences of different natural origins. For example a nucleic acid sequence constituting a plant promoter linked to a nucleic acid sequence encoding human apolipoprotein is considered chimeric. Chimeric nucleic acid sequences also may comprise nucleic acid sequences of the same natural origin, provided they are not naturally linked. For example a nucleic acid sequence constituting a promoter obtained from a particular cell-type may be linked to a nucleic acid sequence encoding a polypeptide obtained from that same cell-type, but not normally linked to the nucleic acid sequence constituting the promoter. Chimeric nucleic acid sequences also include nucleic acid sequences comprising any naturally occurring nucleic acid sequence linked to any non-naturally occurring nucleic acid sequence.

Preparation of Recombinant Expression Vectors Comprising Chimeric Nucleic Acid Sequences Encoding Apolipoprotein and a Nucleic Acid Sequence Capable of Controlling Expression in a Plant Cell The nucleic acid sequences encoding apolipoprotein that may be used in accordance with the methods and compositions provided herein may be any nucleic acid sequence encoding an apolipoprotein polypeptide, including any proapolipoprotein and preproapolipoprotein.

There are a number of different apolipoproteins that are found in human blood plasma, and they can act as signals, that cause lipoproteins to act on certain tissues or that activate enzymes that act on those lipoproteins (Lehninger, A. et al. Principles of Biochemistry, second edition, New York, Worth Publishers, 1993). These proteins include but are not limited to alleles and isoforms of apolipoprotein A-I (Apo AI) (see for example Sharpe C R et al., Nucleic Acids Res. 12 (9), 3917-3932 (1984)), Apo AII ((see for example Sharpe C R et al., Nucleic Acids Res. 12 (9), 3917-3932 (1984)), Apo AIV (see for example Elshourbagy N A et al, J. Biol. Chem. 261 (5), 1998-2002 (1986)), Apo AV (see for example Hubacek et al. Physiol. Res. 2004. 53: 225-228), Apo B-100 (see for example Law S W et al., Proc. Natl. Acad. Sci. U.S.A. 83 (21), 8142-8146 (1986)), Apo B-48 (see for example Powell L M et al., Cell 50 (6), 831-840 (1987)), Apo C-II (see for example Sharpe C R et al., Nucleic Acids Res. 12 (9), 3917-3932 (1984)), Apo C-III (see for example Sharpe C R et al., Nucleic Acids Res. 12 (9), 3917-3932 (1984)), ApoC-IV (see for example Allan C M et al., Genomics 28 (2), 291-300 (1995)), Apo D (Drayna D et al. J. Biol. Chem. 261 (35), 16535-16539 (1986)), Apo E (see for example Brewslow J L et al., J. Biol. Chem. 257 (24), 14639-14641 (1982)), Apo F (see for example Day J R et al., Biochem. Biophys. Res. Commun. 203 (2), 1146-1151 (1994)), Apo H (see for example Mehdi, H., et al., Gene 108 (2), 293-298 (1991) and Apo L (see for example Duchateau, P. N., et al., J. Biol. Chem. 272 (41), 25576-25582 (1997)). Exemplary nucleic acid sequences encoding apolipoprotein are well known to the art and are generally readily available from a diverse variety of mammalian sources including human (see above), porcine (see for example Trieu V N et al., Gene 134 (2), 267-270 (1993)), bovine (see for example Yang, Y. W., et al. J. Mol. Evol. 32 (6), 469-475 (1991)), ovine (see for example Robertson, J. A., et al., J. Steroid Biochem. Mol. Biol. 67 (4), 285-292 (1998)) and the like. Human apolipoprotein encoding sequences that may be used include those encoding polypeptide chains set forth as SEQ ID NO:1, 7 and 8. Further non-human apolipoprotein encoding sequences that may be used in accordance of the present invention are set forth in SEQ ID NO: 9-55 and 241-251. The respective corresponding nucleic acid sequences encoding the apolipoprotein polypeptide chains can be readily identified via the Accession identifier numbers provided in Table 1. Using these nucleic acid sequences, additional novel apolipoprotein encoding nucleic acid sequences may be readily identified using techniques known to those of skill in the art. For example libraries, such as expression libraries, cDNA and genomic libraries, may be screened, and databases containing sequence information from sequencing projects may be searched for similar sequences. Alternative methods to isolate additional nucleic acid sequences encoding apolipoprotein polypeptides may be used, and novel sequences may be discovered and used in accordance with the present invention. In preferred embodiments nucleic acid sequences encoding apolipoprotein are human, porcine and bovine apolipoprotein.

Numerous apolipoprotein analogs are known to the prior art (see for example Cheung M C et al., Biochim Biophys Acta. 1988 May 2; 960(1): 73-82 and Strobl W et al., Pediatr Res. 1988 August; 24(2): 222-8) and may be used in accordance with the present invention. Analogs that may be used herein include human apolipoprotein molecules wherein a variety of natural and synthetic mutations and modifications have been discovered including, but not limited to, point mutations, deletion mutations, frameshift mutations and chemical modifications. In accordance with the present invention in a preferred embodiment, the natural variant known as Apo AI-M is used. Examples of mutations and modifications that may be used in accordance with the present invention include, but are not limited to, those set forth in Table 2.

In preferred embodiments, the nucleic acid sequence encoding apolipoprotein that is used is pro-apolipoprotein.

Alterations to the nucleic acid sequence encoding apolipoprotein to prepare apolipoprotein analogs may be made using a variety of nucleic acid modification techniques known to those skilled in the art, including for example site directed mutagenesis, targeted mutagenesis, random mutagenesis, the addition of organic solvents, gene shuffling or a combination of these and other techniques known to those of skill in the art (Shraishi et al., 1988, Arch. Biochem. Biophys, 358: 104-115; Galkin et al., 1997, Protein Eng. 10: 687-690; Carugo et al., 1997, Proteins 28: 10-28; Hurley et al., 1996, Biochem, 35: 5670-5678; Holmberg et al., 1999, Protein Eng. 12: 851-856).

In accordance herewith the nucleic acid sequence encoding apolipoprotein is linked to a nucleic acid sequence capable of controlling expression of the apolipoprotein polypeptide in a plant cell. Accordingly, the present invention also provides a nucleic acid sequence encoding apolipoprotein linked to a promoter capable of controlling expression in a plant cell. Nucleic acid sequences capable of controlling expression in plant cells that may be used herein include any plant derived promoter capable of controlling expression of polypeptides in plants. Generally, promoters obtained from dicotyledonous plant species will be used when a dicotyledonous plant is selected in accordance herewith, while a monocotyledonous plant promoter will be used when a monocotyledonous plant species is selected. In one embodiment, a promoter is used which results in the expression of the apolipoprotein polypeptide in the entire plant. Constitutive promoters that may be used include, for example, the $^{35}$S cauliflower mosaic virus (CaMV) promoter (Rothstein et al., 1987, Gene 53: 153-161), the rice actin promoter (McElroy et al., 1990, Plant Cell 2: 163-171; U.S. Pat. No. 6,429,357), a ubiquitin promoter, such as the corn ubiquitin promoter (U.S. Pat. Nos. 5,879,903; 5,273,894) and the parsley ubiquitin promoter (Kawalleck, P. et al., 1993, Plant Mol. Biol. 21: 673-684).

In particularly preferred embodiments of the present invention, the apolipoprotein is produced in plant seeds. Production in plants seeds offers flexibility in storage and shipment of apolipoprotein as a raw material, since apolipoprotein retains its activity upon extraction from stored seed. Furthermore, the amount of biomass that needs to be subjected to extraction is limited due to the relatively low water content present in plant seeds. Accordingly, in a preferred embodiment of the present invention the plant cell is a seed cell and the plant is grown into a mature plant capable of setting seed wherein the seed expresses the apolipoprotein. In a further preferred embodiment the nucleic acid sequence capable of controlling expression in a plant cell is a seed-preferred promoter, such as the phaseolin promoter. In such an embodiment a promoter which results in preferential expression of the apolipoprotein polypeptide in seed tissue is used. "Seed-preferred promoters" in this regard are promoters which control expression of a recombinant protein (i.e. apolipoprotein) so that preferably at least 80% of the total amount of recombinant protein present in the mature plant is present in the seed. More preferably at least 90% of the total amount of recombinant protein present in the mature plant is present in the seed. Most preferably at least 95% of the total amount of recombinant protein present in the mature plant is present in the seed. Seed-preferred promoters that may be used in this regard include, for example, the bean phaseolin promoter (Sengupta-Gopalan et al., 1985, Proc. Natl. Acad. Sci. USA 82: 3320-3324); the *Arabidopsis* 18 kDa oleosin promoter (U.S. Pat. No. 5,792,922) or the flax oleosin promoter (WO 01/16340); the flax legumin like seed storage protein (linin) promoter (WO 01/16340); the flax 2S storage protein promoter (WO 01/16340); an endosperm preferred promoter such as the Amy32b promoter (Rogers and Milliman, J. Biol. Chem., 1984, 259: 12234-12240, the Amy6-4 promoter (Kursheed and Rogers, J. Biol. Chem., 1988, 263: 18953-18960 or the Aleurain promoter (Whittier et al., 1987, Nucleic Acids Res., 15: 2515-2535) or the bean arcelin promoter (Jaeger G D, et al., 2002, Nat. Biotechnol. December; 20: 1265-8). New promoters useful in various plants are constantly discovered. Numerous examples of plant promoters may be found in Ohamuro et al. (Biochem. of Plnts., 1989, 15: 1-82).

In preferred embodiments of the present invention the chimeric nucleic acid sequence further comprises a nucleic acid sequence encoding a stabilizing polypeptide linked in reading frame to the nucleic acid sequence encoding the apolipoprotein. The stabilizing polypeptide is used to facilitate protein folding and/or enhance the stable accumulation of the apolipoprotein in plant cells. In addition the stabilizing polypeptide may be used to target the apolipoprotein to a desired location within the plant cell and/or facilitate purification of the apolipoprotein. Preferably the stabilizing polypeptide is a polypeptide that in the absence of the apolipoprotein can readily be expressed and stably accumulates in transgenic plant cells. The stabilizing polypeptide may be a plant specific or non-plant specific polypeptide. Plant-specific stabilizing polypeptides that can be used in accordance with the present invention include oil body proteins (See below) and thioredoxins, for example, the thioredoxin shown in SEQ ID NO:56. Non-plant specific stabilizing polypeptides that may be used in accordance herewith include green fluorescent protein (GFP) (Davis and Vierstra, 1996, Weeds World 3(2): 43-48) (SEQ ID NO:57) and single chain antibodies or fragments thereof. Preferably non-plant specific stabilizing polypeptides are codon optimized for optimal expression in plants.

Single chain antibodies or antibodies that are preferably used herein include single chain antibodies or fragments thereof that facilitate purification of the apolipoprotein. In accordance herewith, for example, a single chain antibody or fragment thereof which is capable of specific assocation with an oil body or oil body protein may be used, thereby permitting copurification of the apolipoprotein with the oil body fraction which can readily be obtained from plant seeds. Preferably the single chain antibody is capable of associating with an oil body protein obtainable from the seed in which the apolipoprotein is expressed, i.e. in an embodiment of the invention in which *Arabidopsis* plant cells are used, a single chain antibody or fragment thereof is selected which is capable of associating with an *Arabidopsis* oil body protein. In a further preferred embodiment, the single chain antibody is a single chain FV antibody capable of specifically associating with the 18 kDa oleosin from *Arabidopsis thaliana* (D9scFv). In the most preferred embodiment, the single chain antibody is shown in SEQ ID NO:240. The term "single chain antibody fragment" (scFv) or "antibody fragment" as used herein means a polypeptide containing a variable light ($V_L$) domain linked to a variable heavy ($V_H$) domain by a peptide linker (L), represented by $V_L$-L-$V_H$. The order of the $V_L$ and $V_H$ domains can be reversed to obtain polypeptides represented as $V_H$-L-$V_L$. "Domain" is a segment of protein that assumes a discrete function, such as antigen binding or antigen recognition. The single chain antibody fragments for use in the present invention can be derived from the light and/or heavy chain variable domains of any antibody. Preferably, the light and heavy chain variable domains are specific for the same antigen. Most preferably the antigen is an oil body protein. The individual antibody fragments which are joined to form a multivalent single chain antibody may be directed against the same antigen or can be directed against different antigens. Methodologies to create single chain antibodies are well known to the art. For example single chain antibodies can be created by by screening single chain (scFV) phage display libraries.

Methodologies to create single chain antibodies from phage display libraries are well known to the art. McCarrerty et al. (Nature 348: 552-554) demonstrated the use of a phage-display system in which fragments of antibodies were expressed as a fusion protein with a fd phage vector to allow for the expression of single chain antibodies on the surface of the phage. The production of a single chain antibody phage display library can be achieved using for example, the Recombinant Phage Antibody System developed by Amersham Biosciences and Cambridge Antibody Technology. A more detailed protocol is available from Amersham Biosciences which is sold as in 3 parts including a mouse scFV molecule, and expression module and a detection module. Briefly, the protocol for the production of single chain antibodies is as follows. Messenger RNA can be obtained from either a mouse hybridoma or mouse spleen cells from a mouse that has been immunized with the antigen of interest. The mouse hybridoma represents the most abundant source for the antibody gene to be cloned as it expressed the heavy and light chain genes for a single antibody but antibodies can also be cloned using spleen cells from an immunized mouse. The mRNA is converted to cDNA using a reverse transcriptase and random hexamer primers. The use of random hexamers will result in cDNA molecules that are sufficient in length to clone the variable regions of the heavy and light chain molecules. After the cDNA molecules are created, primary PCR reactions are performed to amplify the heavy and light variable regions separately. Primers are designed to amplify the heavy or light chain variable region by hybridizing to opposite ends of the chain. Once the variable regions are amplified, the PCR reactions are subjected to agarose gel electrophoresis and gel purified to remove the primers and any extraneous PCR products. Once the heavy and light chain variable regions have been purified they are assembled into a single gene using a linker. The linker region is designed to ensure that the correct reading frame is maintained between the heavy and light chain. For example, the variable heavy ($V_H$) and variable light ($V_L$) chains may be linked using a $(Gly_4Ser)_3$ linker to obtain a single chain antibody fragment (scFv) of approximately 750 base pairs in length. Once the heavy and light chains are assembled with the linker a secondary PCR reaction is performed to amplify the assembled scFV DNA fragments. Primers should be designed to introduce restriction sites to allow for cloning into phagemid expression vectors. For example Sfi I and Not I sites can be added to the 5' and 3' end of these scFv gene for cloning into the pCANTAB 5 E vector (Amersham Biosciences). Once PCR is complete, the DNA fragments should be purified to remove unincorporated primers and dNTPs. This can be achieved using spun-column purification. Once the DNA fragments have been purified and quantified the fragments are digested with the appropriate restriction enzymes to allow for cloning into the appropriate expression vector. The DNA fragments are subsequently ligated into an expression vector, for example pCANTAB 5E (Amersham Biosciences) and introduced into competent *E. coli* cells. The cells should be grown on appropriate selection media to ensure that only cells containing the expression vector will grow (i.e. using a specific carbon source and antibiotic selection). Once the *E. coli* is grown, the phagemid-containing colonies are infected with a M13 helper phage (i.e. KO7-Amersham Biosciences) to yield recombinant phage which display the scFv fragments. The M13 phage will initiate phage replication and complete phage particles will be produced and released from the cells, expressing scFv species on their surface. The phage displaying the correct scFv antibodies are identified by panning using the specific antigen. To eliminate the non-specific phage, the culture of recombinant phage can be transferred to an antigen-coated support (i.e. a flask or a tube), and washed. Only those phage displaying the correct scFv will be bound to the support. A susceptible strain of *E. coli* is subsequently infected with the phage bound to the antigen-coated support. The phage can be enriched by rescuing with the helper phage and panning against the antigen multiple times or can be plated directly onto a solid medium without further enrichment. The *E. coli* cells that have been infected with the phage selected against the appropriate antigen are plated and individual colonies are picked. Phage, from the individual colonies, are then assayed using for example the ELISA assay (enzyme-linked immunosorbent assay). Phage antibodies which are positive using the ELISA assay can then be used to infect *E. coli* HB2151 cells for the production of soluble recombinant antibodies. Once the appropriate clones are selected the sequence of the scFv antibody gene can be identified and used for the present invention.

The stabilizing protein may be linked to the apolipoprotein via a linker which can be cleaved to release the apolipoprotein in its free native form. Linkers that may be included in this regard include peptide sequences recognized by Factor Xa, IgA protease, or entorokinase. In a particularly preferred embodiment the linker encodes a chymosin pro-sequence which may be cleaved with mature chymosin as set forth in PCT Patent Application WO 98/49326.

In preferred embodiments the chimeric nucleic acid sequence further comprises a "targeting signal". Targeting signal as used herein means any amino acid sequence capable of directing the apolipoprotein polypeptide, when expressed, to a desired location within the plant cell. Suitable targeting signals that may be used herein include those capable of targeting the apolipoprotein polypeptide to the endoplasmic reticulum or a storage vesicle derived from the endoplasmic reticulum, such as an oil body, and the apoplast.

In order to achieve accumulation of the apolipoprotein in the ER or an ER-derived storage vesicle, the polypeptide encoding the polypeptide encoding the apolipoprotein is linked to a targeting signal which causes the apolipoprotein to be retained in the ER or an ER-derived storage vesicle. In a preferred embodiment of the present invention, the targeting signal that is capable of retaining the apolipoprotein in the ER contains a C-terminal ER-retention motif. Examples of such C-terminal ER-retention motifs include KDEL, HDEL, DDEL, ADEL and SDEL sequences. Other examples include HDEF (Lehmann et al., 2001, Plant Physiol. 127(2): 436-439), or two arginine residues close to the N-terminus located at positions 2 and 3, 3 and 4, or 4 and 5 (Abstract from Plant Biology 2001 Program, ASPB, July 2001, Providence, R.I., USA). Nucleic acid sequences encoding a C-terminal retention motif are preferably linked to the nucleic acid sequence encoding the apolipoprotein in such a manner that the polypeptide capable of retaining the apolipoprotein in the ER is linked to the C-terminal end of the apolipoprotein polypeptide.

In embodiments of the present invention in which the apolipoprotein is retained in the ER the chimeric nucleic acid sequence additionally may contain a nucleic sequence which targets the nucleic acid sequence to the endomembrane system ("signal peptide"). In embodiments of the present invention in which the apolipoprotein polypeptide is retained in the ER using a sequence, such as KDEL, HDEL or SDEL polypeptide, it is particularly desirable to include a nucleic acid sequence encoding a signal peptide. Exemplary signal peptides that may be used herein include the tobacco pathogenesis related protein (PR-S) signal sequence (SEQ.ID.NO: 58) (Sijmons et al, 1990, Bio/technology, 8: 217-221), lectin signal sequence (Boehn et al., 2000, Transgenic Res, 9(6): 477-86), signal sequence from the hydroxyproline-rich glycoprotein from Phaseolus vulgaris (Yan et al., 1997, Plant Phyiol. 115(3): 915-24 and Corbin et al., 1987, Mol Cell Biol 7(12): 4337-44), potato patatin signal sequence (Iturriaga, G et al., 1989, Plant Cell 1: 381-390 and Bevan et al., 1986, Nuc. Acids Res. 41: 4625-4638.) and the barley alpha amylase signal sequence (Rasmussen and Johansson, 1992, Plant Mol. Biol. 18(2): 423-7). Example No. 3 herein shows accumulation of the apolipoprotein in the ER.

In a further preferred embodiment, the apoliprotein polypeptide is linked to a polypeptide that is capable of retaining the apolipoprotein polypeptide in an ER-derived storage vesicle. In a preferred embodiment, the ER derived storage vesicle is an oil body and the apolipoprotein is linked to an oil body protein. Oil body proteins that may be used in this regard include any protein that naturally associates with an oil body (see SEQ ID NOs:59-137 in Table 3). The respective corresponding nucleic acid sequences encoding the oil body protein polypeptide chains can be readily identified via the Accession identifier numbers provided in Table 3. Using these nucleic acid sequences, additional novel oil body proteins encoding nucleic acid sequences may be readily identified using techniques known to those of skill in the art. For example libraries, such as expression libraries, cDNA and genomic libraries, may be screened, and databases containing sequence information from sequencing projects may be searched for similar sequences. Alternative methods to isolate additional nucleic acid sequences encoding oil body protein polypeptides may be used, and novel sequences may be discovered and used in accordance with the present invention. Oil body proteins that are particularly preferred are oleosins, for example a corn oleosin (Bowman-Vance et al., 1987, J. Biol. Chem. 262: 11275-11279; Qu et al., 1990, J. Biol. Chem. 265: 2238-2243 or Brassica (Lee et al., 1991, Plant Physiol. 96: 1395-1397), caleosins, see for example Genbank accession number AF067857) and steroleosins (Lin et al., 2002 Plant Physiol. 128(4): 1200-11). In a further preferred embodiment, the oil body protein is a plant oleosin and shares sequence similarity with other plant oleosins such as the oleosin isolated from Arabidopsis thaliana (SEQ ID NO:138) or Brassica napus (SEQ ID NO:139). In another embodiment, the oil body protein is a caleosin or calcium binding protein from plant, fungal or other sources and shares sequence homology with plant caleosins such as the caleosin isolated from Arabidopsis thaliana (SEQ ID NO:140 and SEQ ID NO:141) In another embodiment the oil body protein is a steroleosin (SEQ ID NO:142), a sterol binding dehydrogenase (Lin L-J et al, (2002) Plant Physiol 128: 1200-1211). This embodiment of the present invention is exemplified in Example No. 3.

In addition, in accordance with the present invention, the apolipoprotein may also be targeted to an oil body by expressing the apolipoprotein in such a manner that the apolipoprotein does not include a targeting signal, provided however, that the nucleic acid sequence encoding the apolipoprotein comprises an apolipoprotein pro-peptide. This embodiment of the present invention is exemplified in Example No. 3.

Polypeptides capable of retaining the apolipoprotein in the ER or an ER derived storage vesicle are typically not cleaved and the apolipoprotein may accumulate in the form of a fusion protein, which is, for example, typically the case when a KDEL retention signal is used to retain the polypeptide in the ER or when an oil body protein is used to retain the polypeptide in an oil body.

In another embodiment of the present invention the apolipoprotein polypeptide is expressed in such a manner the polypeptide accumulates in the apoplast. In order to achieve such accumulation the chimeric nucleic acid sequence preferable comprises a targeting sequence capable of directing the apoliprotein polypeptide to the ER ("signal peptide"). Exemplary signal peptides that may be used herein include the hereinbefore mentioned tobacco pathogenesis related protein (PR-S) signal sequence (SEQ.ID.NO:58) (Sijmons et al., 1990, Bio/technology, 8: 217-221), lectin signal sequence (Boehn et al., 2000, Transgenic Res, 9(6): 477-86), signal sequence from the hydroxyproline-rich glycoprotein from Phaseolus vulgaris (Yan et al., 1997, Plant Phyiol. 115(3): 915-24 and Corbin et al., 1987, Mol Cell Biol 7(12): 4337-44), potato patatin signal sequence (Iturriaga, G et al., 1989, Plant Cell 1: 381-390 and Bevan et al., 1986, Nuc. Acids Res. 41: 4625-4638.) and the barley alpha amylase signal sequence (Rasmussen and Johansson, 1992, Plant Mol. Biol. 18(2): 423-7). Such targeting signals may in vivo be cleaved off from the apolipoprotein polypeptide, which for example is typically the case when an apoplast targeting signal, such as the tobacco pathogenesis related protein-S(PR-S) signal sequence (Sijmons et al., 1990, Bio/technology, 8: 217-221) is used. In general there is little conservation of the primary amino acid sequence, although general physiochemical properties are conserved to some extent. The generic structure of signal peptides has 3 regions, the short amino-terminal "n-region" contains positively charged residues, the central hydrophobic "h-region" ranges in size from 7 to 15amino acids and the carboxy-terminal "c-region" contains polar amino acids and a cleavage site that is recognized by membrane bound signal peptidase enzymes (Nakai K., 2000, Advances in Protein Chem 54: 277-344). A targeting signal that also may be used in accordance herewith includes the native apolipoprotein signal sequence (18 amino acids in length in case of the human sequence). In preferred embodiments hereof an N-terminally located apoplast targeting sequence, such as the hereinbefore mentioned tobacco PR--S sequence is used combined with a C-terminally located ER retention sequence such as the KDEL sequence.

In yet a further preferred embodiment, the nucleic acid sequence encoding the apolipoprotein is expressed in such a manner that the apolipoprotein accumulates in the cytoplasm. In such an embodiment the nucleic acid sequence does not comprise a targeting signal. Preferably in such an embodiment the apolipoprotein comprises a further stabilizing polypeptide, such as green fluorescent protein (GFP).

The chimeric nucleic acid sequence may also comprise N-and/or C-terminal polypeptide extensions. Such extensions may be used to stabilize and/or assist in folding of the apolipoprotein polypeptide chain or they may facilitate targeting to a compartment in the cell, for example the oil body. Polypeptide extensions that may be used in this regard include for example a nucleic acid sequence encoding a single chain antibody, or a nucleic acid sequence encoding green fluorescent protein (Davis and Vierstra, 1996, Weeds World 3(2): 43-48), or combinations of such polypeptides. Single chain antibody extensions that are particularly desirable include those that permit association of the apoliprotein with an oil body in order to facilitate purification of the apolipoprotein in association with the oil body fraction. Such extensions are preferably included in embodiments of the present invention in which the apolipoprotein is expressed in the plant seed and targeted within the seed cell to the ER or to the apoplast.

In a further embodiment, a cleavage site may be located upstream of the N-terminus or downstream of the C-terminus of the Apolipoprotein A-I peptide allowing for the Apolipoprotein A-I polypeptide to be cleaved from the fusion partner, thereby obtaining isolated Apolipoprotein A-I. Examples of such cleavage sites can be found in WO 98/49326 (Method for the cleavage of fusion proteins) and related applications and LaVallie et al. (1994) Enzymatic and chemical cleavage of fusion proteins In Current Protocols in Molecular Biology pp 16.4.5-16.4.17, John Wiley and Sons, Inc., New York N.Y. In a preferred embodiment, the cleavage site is KLIP 8 (SEQ ID NO:143) which is cleavable by aspartic proteases including chymosin. In a further preferred embodiment, an extra methionine residue is added to the N-terminus of the Apo AI polypeptide or pro-Apo AI polypeptide.

The invention further provides methods for the separation of heterologous proteins from host cell components by partitioning of the oil body fraction and subsequent release of the heterologous protein via specific cleavage of the heterologous protein—oil body protein fusion. Optionally a cleavage site may be located upstream of the N-terminus and downstream of the C-terminus of the heterologous polypeptide allowing the fusion polypeptide to be cleaved and separated by phase separation into its component peptides.

The nucleic acid sequence encoding apolipoprotein may be altered, to improve expression levels for example, by optimizing the nucleic acid sequence in accordance with the preferred codon usage for a particular plant cell type which is selected for the expression of the apolipoprotein polypeptide, or by altering motifs known to destabilize mRNAs (see for example: PCT Patent Application 97/02352). Comparison of the codon usage of the nucleic acid sequence encoding the apolipoprotein polypeptide with the codon usage of the plant cell type will enable the identification of codons that may be changed. Construction of synthetic genes by altering the codon usage is described in for example PCT Patent Application 93/07278.

In a preferred embodiment, the nucleic acid sequence encoding apolipoprotein that is used is represented by SEQ.ID.NO 1, SEQ.ID.NO. 3 or SEQ.ID.NO. 5.

Certain genetic elements capable of enhancing expression of the apolipoprotein polypeptide may be used herein. These elements include the untranslated leader sequences from certain viruses, such as the AMV leader sequence (Jobling and Gehrke, 1987, Nature, 325: 622-625) and the intron associated with the maize ubiquitin promoter (U.S. Pat. No. 5,504, 200). Generally the chimeric nucleic acid sequence will be prepared so that genetic elements capable of enhancing expression will be located 5' to the nucleic acid sequence encoding the apolipoprotein polypeptide.

In accordance with the present invention the chimeric nucleic acid sequences comprising a promoter capable of controlling expression in plant linked to a nucleic acid sequence encoding an apolipoprotein polypeptide can be integrated into a recombinant expression vector which ensures good expression in the cell. Accordingly, the present invention includes a recombinant expression vector comprising in the 5' to 3' direction of transcription as operably linked components:

(i) a nucleic acid sequence capable of controlling expression in plant cells; and (ii) a nucleic acid sequence encoding an apolipoprotein polypeptide;

wherein the expression vector is suitable for expression in a plant cell. The term "suitable for expression in a plant cell" means that the recombinant expression vector comprises the chimeric nucleic acid sequence of the present invention linked to genetic elements required to achieve expression in a plant cell. Genetic elements that may be included in the expression vector in this regard include a transcriptional termination region, one or more nucleic acid sequences encoding marker genes, one or more origins of replication and the like. In preferred embodiments, the expression vector further comprises genetic elements required for the integration of the vector or a portion thereof in the plant cell's nuclear genome, for example the T-DNA left and right border sequences which facilitate the integration into the plant's nuclear genome in embodiments of the invention in which plant cells are transformed using *Agrobacterium*. In a further preferred embodiment said plant cell is a plant seed cell.

As hereinbefore mentioned, the recombinant expression vector generally comprises a transcriptional terminator which besides serving as a signal for transcription termination further may serve as a protective element capable of extending the mRNA half life (Guarneros et al., 1982, Proc. Natl. Acad. Sci. USA, 79: 238-242). The transcriptional terminator is generally from about 200 nucleotides to about 1000 nucleotides and the expression vector is prepared so that the transcriptional terminator is located 3' of the nucleic acid sequence encoding apolipoprotein. Termination sequences that may be used herein include, for example, the nopaline termination region (Bevan et al., 1983, Nucl. Acids. Res., 11: 369-385), the phaseolin terminator (van der Geest et al., 1994, Plant J. 6: 413-423), the arcelin terminator (Jaeger G D, et al., 2002, Nat. Biotechnol. 20: 1265-8), the terminator for the octopine synthase genes of *Agrobacterium tumefaciens* or other similarly functioning elements. Transcriptional terminators may be obtained as described by An (An, 1987, Methods in Enzym. 153: 292).

Pursuant to the present invention the expression vector may further contain a marker gene. Marker genes that may be used in accordance with the present invention include all genes that allow the distinction of transformed cells from non-transformed cells, including all selectable and screenable marker genes. A marker gene may be a resistance marker such as an antibiotic resistance marker against, for example, kanamycin (U.S. Pat. No. 6,174,724), ampicillin, G418, bleomycin, hygromycin which allows selection of a trait by chemical means or a tolerance marker against a chemical agent, such as the normally phytotoxic sugar mannose (Negrotto et al., 2000, Plant Cell Rep. 19: 798-803). Other convenient markers that may be used herein include markers capable of conveying resistance against herbicides such as glyphosate (U.S. Pat. Nos. 4,940,935; 5,188,642), phosphinothricin (U.S. Pat. No. 5,879,903) or sulphonyl ureas (U.S. Pat. No. 5,633,437). Resistance markers, when linked in close proximity to nucleic acid sequence encoding the apolipoprotein polypeptide, may be used to maintain selection pressure on a population of plant cells or plants that have not lost the nucleic acid sequence encoding the apolipoprotein polypeptide. Screenable markers that may be employed to identify transformants through visual inspection include β-glucuronidase (GUS) (U.S. Pat. Nos. 5,268,463 and 5,599,670) and green fluorescent protein (GFP) (Niedz et al., 1995, Plant Cell Rep., 14: 403).

Recombinant vectors suitable for the introduction of nucleic acid sequences into plants include *Agrobacterium* and *Rhizobium* based vectors, such as the Ti and Ri plasmids, including for example pBIN19 (Bevan, Nucl. Acid. Res., 1984, 22: 8711-8721), pGKB5 (Bouchez et al., 1993, C R Acad. Sci. Paris, Life Sciences, 316: 1188-1193), the pCGN series of binary vectors (McBride and Summerfelt, 1990, Plant Mol. Biol., 14: 269-276) and other binary vectors (e.g. U.S. Pat. No. 4,940,838).

The recombinant expression vectors of the present invention may be prepared in accordance with methodologies well known to those skilled in the art of molecular biology. Such preparation will typically involve the bacterial species *Escherichia coli* as an intermediairy cloning host. The preparation of the *E. coli* vectors as well as the plant transformation vectors may be accomplished using commonly known techniques such as restriction digestion, ligation, gelectrophoresis, DNA sequencing, the Polymerase Chain Reaction (PCR) and other methodologies. A wide variety of cloning vectors is available to perform the necessary steps required to prepare a recombinant expression vector. Among the vectors with a replication system functional in *E. coli*, are vectors such as pBR322, the pUC series of vectors, the M13 mp series of vectors, pBluescript etc. Typically, these cloning vectors contain a marker allowing selection of transformed cells. Nucleic acid sequences may be introduced in these vectors, and the vectors may be introduced in *E. coli* grown in an appropriate medium. Recombinant expression vectors may readily be recovered from cells upon harvesting and lysing of the cells. Further, general guidance with respect to the preparation of recombinant vectors may be found in, for example: Sambrook et al., Molecular Cloning, a Laboratory Manual, Cold Spring Harbor Laboratory Press, 1989, Vol. 3.

Preparation of Plants Comprising Seed Capable of Expressing Apolipoprotein

In accordance with the present invention the chimeric nucleic acid sequence is introduced into a plant cell and the cells are grown into mature plants, wherein the plant expresses the apolipoprotein polypeptide.

In accordance herewith any plant species or plant cell may be selected. Particular cells used herein include cells obtainable from *Arabidopsis thaliana*, Brazil nut (*Betholettia excelsa*); castor bean (*Riccinus communis*); coconut (*Cocus nucifera*); coriander (*Coriandrum sativum*); cotton (*Gossypium* spp.); groundnut (*Arachis Hypogaea*); jojoba (*Simmondsia chinensis*); linseed/flax (*Linum usitatissimum*); maize (*Zea mays*); mustard (*Brassica* spp. and *Sinapis alba*); oil palm (*Elaeis guineeis*); olive (*Olea eurpaea*); rapeseed (*Brassica* spp.); rice (*Oryza sativa*); safflower (*Carthamus tinctorius*); soybean (*Glycine max*); squash (*Cucurbita maxima*); barley (*Hordeum vulgare*); wheat (*Traeticum aestivum*); duckweed (*Lemnaceae* sp.) and sunflower (*Helianthus annuus*).

In accordance herewith in a preferred embodiment plant species or plant cells from oil seed plants are used. Oil seed plants that may be used herein include peanut (*Arachis hypogaea*); mustard (*Brassica* spp. and *Sinapis alba*); rapeseed (*Brassica* spp.); chickpea (*Cicer arietinum*); soybean (*Glycine max*); cotton (*Gossypium hirsutum*); sunflower (*Helianthus annuus*); (Lentil *Lens culinaris*); linseed/flax (*Linum usitatissimum*); white clover (*Trifolium repens*); olive (*Olea eurpaea*); oil palm (*Elaeis guineeis*); safflower (*Carthamus tinctorius*) and narbon bean (*Vicia narbonesis*).

In accordance herewith in a particularly preferred embodiment *Arabidopsis*, flax or safflower is used.

Methodologies to introduce plant recombinant expression vectors into a plant cell, also referred to herein as "transformation", are well known to the art and typically vary depending on the plant cell that is selected. General techniques to introduce recombinant expression vectors in cells include, electroporation; chemically mediated techniques, for example $CaCl_2$ mediated nucleic acid uptake; particle bombardment (biolistics); the use of naturally infective nucleic acid sequences, for example virally derived nucleic acid sequences, or *Agrobacterium* or *Rhizobium* derived sequences, polyethylene glycol (PEG) mediated nucleic acid uptake, microinjection and the use of silicone carbide whiskers.

In preferred embodiments, a transformation methodology is selected which will allow the integration of the chimeric nucleic acid sequence in the plant cell's genome, and preferably the plant cell's nuclear genome. In accordance herewith this is considered particularly desirable as the use of such a methodology will result in the transfer of the chimeric nucleic acid sequence to progeny plants upon sexual reproduction. Transformation methods that may be used in this regard include biolistics and *Agrobacterium* mediated methods.

Transformation methodologies for dicotyledenous plant species are well known. Generally, *Agrobacterium* mediated transformation is used because of its high efficiency, as well as the general susceptibility by many, if not all, dicotyledenous plant species. *Agrobacterium* transformation generally involves the transfer of a binary vector, such as one of the hereinbefore mentioned binary vectors, comprising the chimeric nucleic acid sequence of the present invention from *E. coli* to a suitable *Agrobacterium* strain (e.g. EHA101 and LBA4404) by, for example, tri-parental mating with an *E. coli* strain carrying the recombinant binary vector and an *E. coli* strain carrying a helper plasmid capable of mobilizing the binary vector to the target *Agrobacterium* strain, or by DNA transformation of the *Agrobacterium* strain (Hofgen et al., Nucl. Acids. Res., 1988, 16: 9877). Other techniques that may be used to transform dicotyledenous plant cells include biolistics (Sanford, 1988, Trends in Biotechn. 6: 299-302);

electroporation (Fromm et al., 1985, Proc. Natl. Acad. Sci. USA., 82: 5824-5828); PEG mediated DNA uptake (Potrykus et al., 1985, Mol. Gen. Genetics, 199: 169-177); microinjection (Reich et al., Bio/Techn., 1986, 4: 1001-1004); and silicone carbide whiskers (Kaeppler et al., 1990, Plant Cell Rep., 9: 415-418) or in planta transformation using, for example, a flower dipping methodology (Clough and Bent, 1998, Plant J., 16: 735-743).

Monocotyledonous plant species may be transformed using a variety of methodologies including particle bombardment (Christou et al., 1991, Biotechn. 9: 957-962; Weeks et al., Plant Physiol., 1993, 102: 1077-1084; Gordon-Kamm et al., Plant Cell, 1990, 2: 5603-618); PEG mediated DNA uptake (European Patents 0292 435; 0392 225) or *Agrobacterium* mediated transformation (Goto-Fumiyuki et al., 1999, Nature-Biotech. 17: 282-286).

The exact plant transformation methodology may vary somewhat depending on the plant species and the plant cell type (e.g. seedling derived cell types such as hypocotyls and cotyledons or embryonic tissue) that is selected as the cell target for transformation. As hereinbefore mentioned in a particularly preferred embodiment safflower is used. A methodology to obtain safflower transformants is available in Baker and Dyer (Plant Cell Rep., 1996, 16: 106-110). Additional plant species specific transformation protocols may be found in: Biotechnology in Agriculture and Forestry 46: Transgenic Crops I (Y. P. S. Bajaj ed.), Springer-Verlag, New York (1999), and Biotechnology in Agriculture and Forestry 47: Transgenic Crops II (Y. P. S. Bajaj ed.), Springer-Verlag, New York (2001).

Following transformation, the plant cells are grown and upon the emergence of differentiating tissue, such as shoots and roots, mature plants are regenerated. Typically a plurality of plants is regenerated. Methodologies to regenerate plants are generally plant species and cell type dependent and will be known to those skilled in the art. Further guidance with respect to plant tissue culture may be found in, for example: Plant Cell and Tissue Culture, 1994, Vasil and Thorpe Eds., Kluwer Academic Publishers; and in: Plant Cell Culture Protocols (Methods in Molecular Biology 111), 1999, Hall Eds, Humana Press.

In one aspect, the present invention provides a method of obtaining plant seed comprising apolipoprotein. Accordingly, the present invention provides a method for obtaining plant seed comprising apolipoprotein comprising:
  (a) providing a chimeric nucleic acid construct comprising in the 5' to 3' direction of transcription as operably linked components:
    (i) a nucleic acid sequence capable of controlling expression in plant seed cells; and
    (ii) a nucleic acid sequence encoding an apolipoprotein polypeptide;
  (b) introducing the chimeric nucleic acid construct into a plant cell;
  (c) growing the plant cell into a mature plant; and
  (d) obtaining seed from said plant wherein the seed comprises apolipoprotein.

The seeds may be used to obtain a population of progeny plants each comprising a plurality of seeds expressing apolipoprotein. In a preferred embodiment at least approximately 0.25% of the total seed protein is apolipoprotein. More preferably least approximately 0.5% of the total seed protein is apolipoprotein. Most preferably at least approximately 1.0% of the total seed protein is apolipoprotein.

In preferred embodiments, a plurality of transformed plants is obtained, grown, and screened for the presence of the desired chimeric nucleic acid sequence, the presence of which in putative transformants may be tested by, for example, growth on a selective medium, where herbicide resistance markers are used, by direct application of the herbicide to the plant, or by Southern blotting. If the presence of the chimeric nucleic acid sequence is detected, transformed plants may be selected to generate progeny and ultimately mature plants comprising a plurality of seeds comprising the desired chimeric nucleic acid sequence. Such seeds may be used to isolate apolipoprotein or they may be planted to generate two or more subsequent generations. It will generally be desirable to plant a plurality of transgenic seeds to obtain a population of transgenic plants, each comprising seeds comprising a chimeric nucleic acid sequence encoding apolipoprotein. Furthermore, it will generally be desirable to ensure homozygosity in the plants to ensure continued inheritance of the recombinant polypeptide. Methods for selecting homozygous plants are well known to those skilled in the art. Methods for obtaining homozygous plants that may be used include the preparation and transformation of haploid cells or tissues followed by the regeneration of haploid plantlets and subsequent conversion to diploid plants for example by the treatment with colchine or other microtubule disrupting agents. Plants may be grown in accordance with otherwise conventional agricultural practices.

In another aspect, the present invention also provides plants capable of setting seed expressing apolipoprotein. In a preferred embodiment of the invention, the plants capable of setting seed comprise a chimeric nucleic acid sequence comprising in the 5' to 3' direction of transcription:
  (a) a first nucleic acid sequence capable of controlling expression in a plant seed cell operatively linked to;
  (b) a second nucleic acid sequence encoding an apolipoprotein polypeptide, wherein the seed contains apolipoprotein.

In a preferred embodiment the chimeric nucleic acid sequence is stably integrated in the plant's nuclear genome.

In yet another aspect, the present invention provides plant seeds expressing apolipoprotein. In a preferred embodiment of the present invention, the plant seeds comprise a chimeric nucleic acid sequence comprising in the 5' to 3' direction of transcription:
  (a) a first nucleic acid sequence capable of controlling expression in a plant seed cell operatively linked to;
  (b) a second nucleic acid sequence encoding an apolipoprotein polypeptide.

The apolipoprotein polypeptide may be present in a variety of different types of seed cells including, for example, the hypocotyls and the embryonic axis, including in the embryonic roots and embryonic leafs, and where monocotyledonous plant species, including cereals and corn, are used in the endosperm tissue.

Once the plants have been obtained the apolipoprotein protein may be extracted and obtained from the plant in a more or less pure form.

Accordingly, the present invention provides a method for preparing substantially pure apolipoprotein comprising:
  (a) providing a chimeric nucleic acid construct comprising in the 5' to 3' direction of transcription as operably linked components:
    (i) a nucleic acid sequence capable of controlling expression in plant seed cells; and
    (ii) a nucleic acid sequence encoding an apolipoprotein polypeptide;
  (b) introducing the chimeric nucleic acid construct into a plant cell;

(c) growing the plant cell into a mature plant; and
obtaining seed from said plant wherein the seed comprises apolipoprotein; and
(e) separating apolipoprotein from the plant seed constituents to obtain substantially pure apolipoprotein.

In order to separate the apolipoprotein from the seed constituents, plant seeds may be ground using any comminuting process resulting in a substantial disruption of the seed cell membrane and cell walls.

Both dry and wet milling conditions (U.S. Pat. No. 3,971, 856; Lawhon et al., 1977, J. Am. Oil Chem. Soc., 63: 533-534) may be used. Suitable milling equipment in this regard include colloid mills, disc mills, IKA mills, industrial scale homogenizers and the like. The selection of the milling equipment will depend on the seed type and throughput requirements. Solid seed contaminant such as seed hulls, fibrous materials, undissolved carbohydrates, proteins and other water insoluble contaminants may be removed from the seed fraction using for example size-exclusion based methodologies, such as filtering or gravitational based processes such as centrifugation. In preferred embodiments, the use of organic solvents commonly used in oil extraction, such as hexane, is avoided because such solvents may damage the apolipoprotein polypeptide. As hereinbefore mentioned in preferred embodiments of the present invention the apoliprotein is prepared in a manner that permits association of the apolipoprotein polypeptide with seed oil bodies. Accordingly, seed oil bodies comprising the apolipoprotein may be prepared following comminuting of the seed using for example the methodologies detailed in U.S. Pat. No. 6,146,645. Thus the present invention also includes substantially pure oil bodies comprising apolipoprotein obtained from plant seed. The oil bodies may be used as a refined plant seed fraction to further purify apolipoprotein. Substantially pure apolipoprotein may be recovered from seed using a variety of additional purification methodologies such as centrifugation based techniques; size exclusion based methodologies, including for example membrane ultrafiltration and crossflow ultrafiltration; and chromatographic techniques, including for example ion-exchange chromatography, size exclusion chromatography, affinity chromatography, high performance liquid chromatography (HPLC), fast protein liquid chromatography (FPLC), hydrophobic interaction chromatography and the like. Generally, a combination of such techniques will be used to obtain substantially pure apolipoprotein. A preferred methodology to obtain substantially pure apoliprotein in its native form from transgenic plant seeds is further detailed in Example 6 herein. Thus the present invention also includes substantially pure apolipoprotein obtained from a plant.

Pharmaceutical apolipoprotein formulations may be prepared from the purified apolipoprotein and such formulations may be used to treat vascular diseases. Generally the purified apolipoprotein will be admixed with a pharmaceutically acceptable carrier or diluent in amounts sufficient to exert a therapeutically useful effect in the absence of undesirable side effects on the patient treated. To formulate an apolipoprotein composition, the weight fraction of apolipoprotein is dissolved, suspended, dispersed or otherwise mixed in a selected carrier or diluent at an effective concentration such that the treated condition is ameliorated. The pharmaceutical apolipoprotein formulations are preferably formulated for single dosage administration. Therapeutically effective doses for the parenteral delivery of human apolipoprotein are well known to the art. Where apolipoprotein analogs are used or other modes of delivery are used therapeutically effective doses may be readily empirically determined by those of skill in the art using known testing protocols or by extrapolation of in-vivo or in-vitro test data. It is understood however that concentrations and dosages may vary in accordance with the severity of the condition alleviated. It is further understood that for any particular subject, specific dosage regimens may be adjusted over time according to individual judgement of the person administering or supervising administration of the formulations.

Pharmaceutical solutions or suspensions may include for example a sterile diluent such as, for example, water, lactose, sucrose, dicalcium phosphate, or carboxymethyl cellulose. Carriers that may be used include water, saline solution, aqueous dextrose, glycerol, glycols, ethanol and the like, to thereby form a solution or suspension. If desired the pharmaceutical compositions may also contain non-toxic auxiliary substances such a wetting agents; emulsifying agents; solubilizing agents; antimicrobial agents, such as benzyl alcohol and methyl parabens; antioxidants, such as ascorbic acid and sodium bisulfite; chelating agents such as ethylenediaminetetraacetic acid (EDTA); pH buffering agents such as actetate, citrate or phosphate buffers; and combinations thereof.

The final formulation of the apolipoprotein preparation will generally depend on the mode of apolipoprotein delivery. The apolipoprotein prepared in accordance with the present invention may be delivered in any desired manner; however parenteral, oral and nasal forms of delivery are considered the most likely used modes of delivery. Parenteral preparations can be enclosed in ampoules, disposable syringes or single or multiple dose vials made of glass, plastic or other such suitable materials.

EXAMPLES

The following examples are offered by way of illustration and not by way of limitation.

Example 1

Construction of Apolipoprotein A-I Clones

Apo10

Figure 3A:
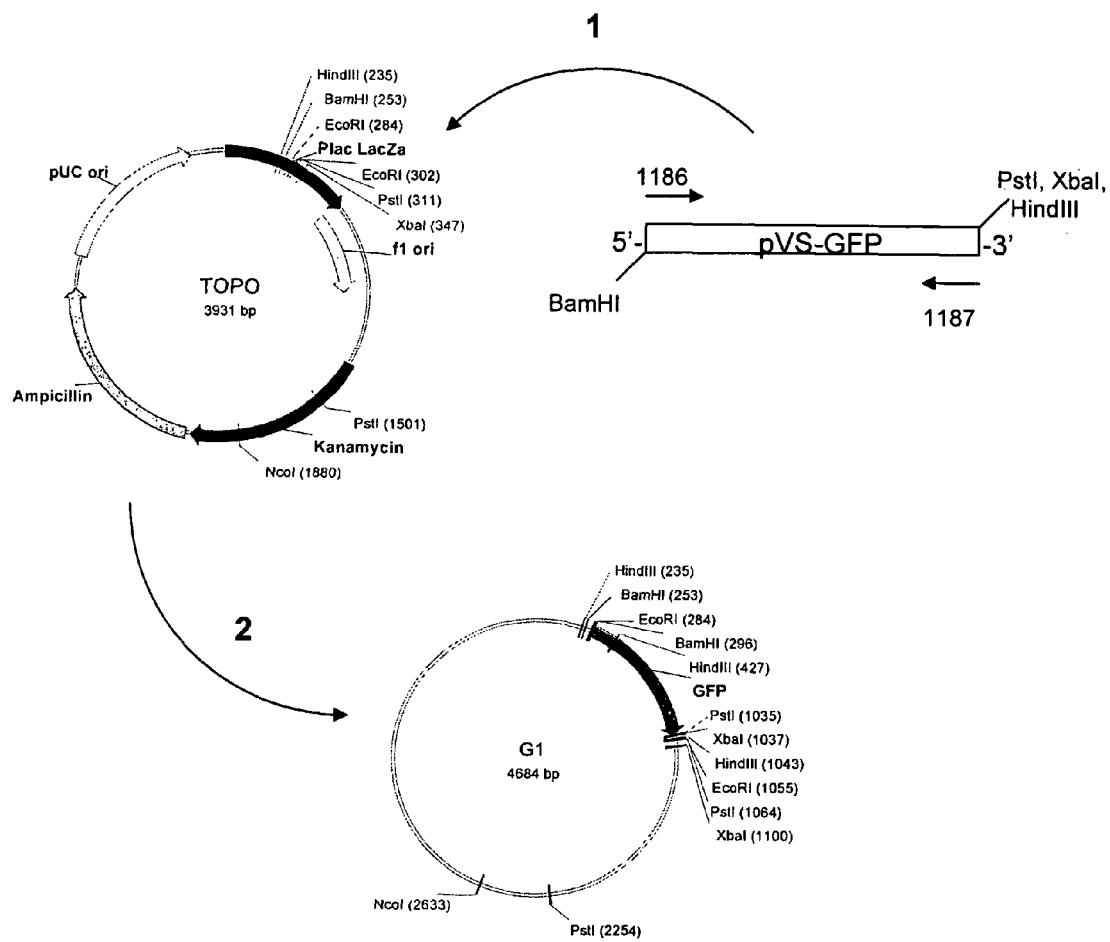
FIG. 3(A). Schematic drawing for the cloning strategy for the GFP coding region to be used in the Apo AI-GFP translational fusion constructs.
Figure 3B:
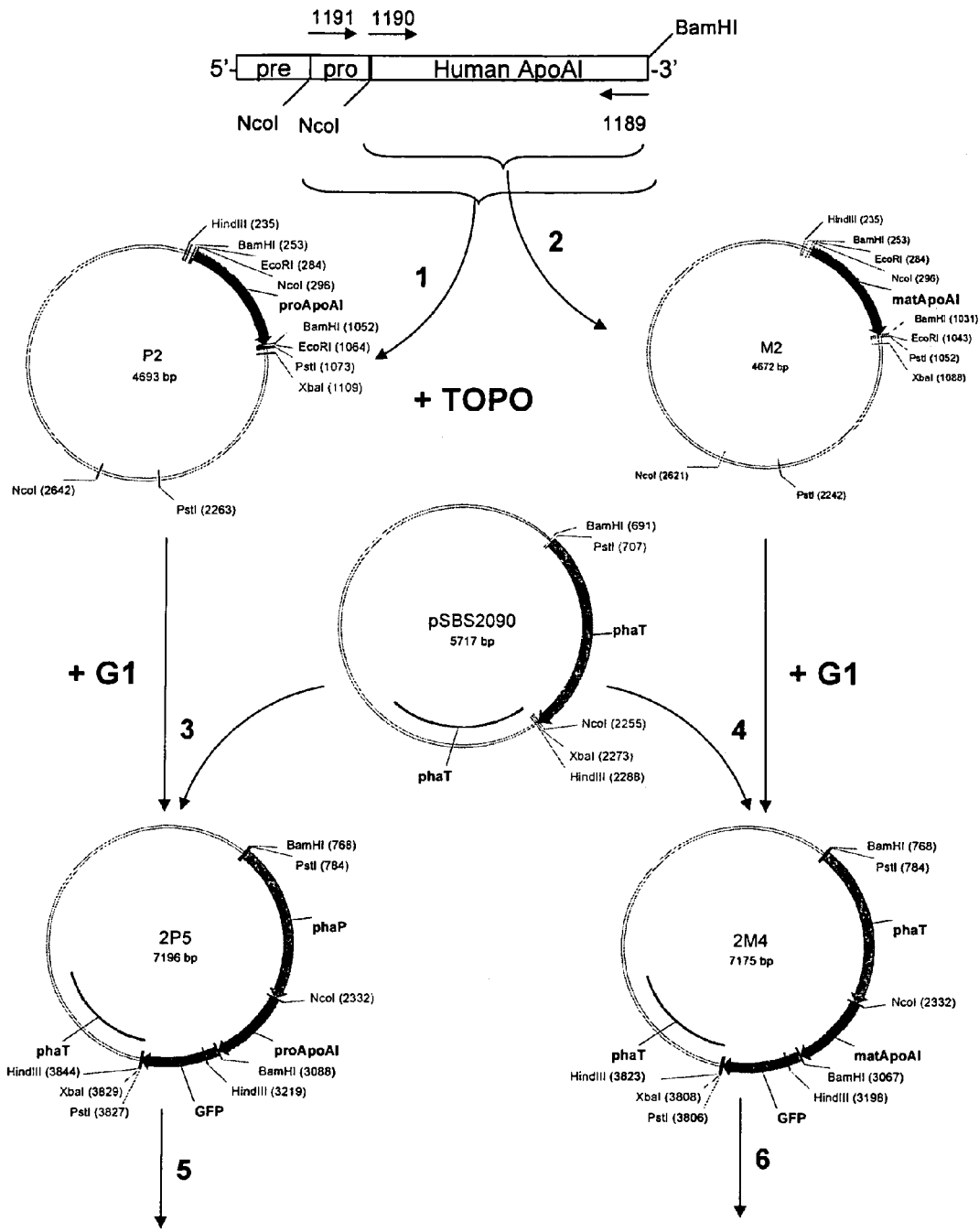
FIG. 3(B). Schematic drawing for the cloning strategy for the pro- and mature coding regions of Apo AI and seed-specific Apo AI-GFP translational fusion constructs.
Figure 3C:
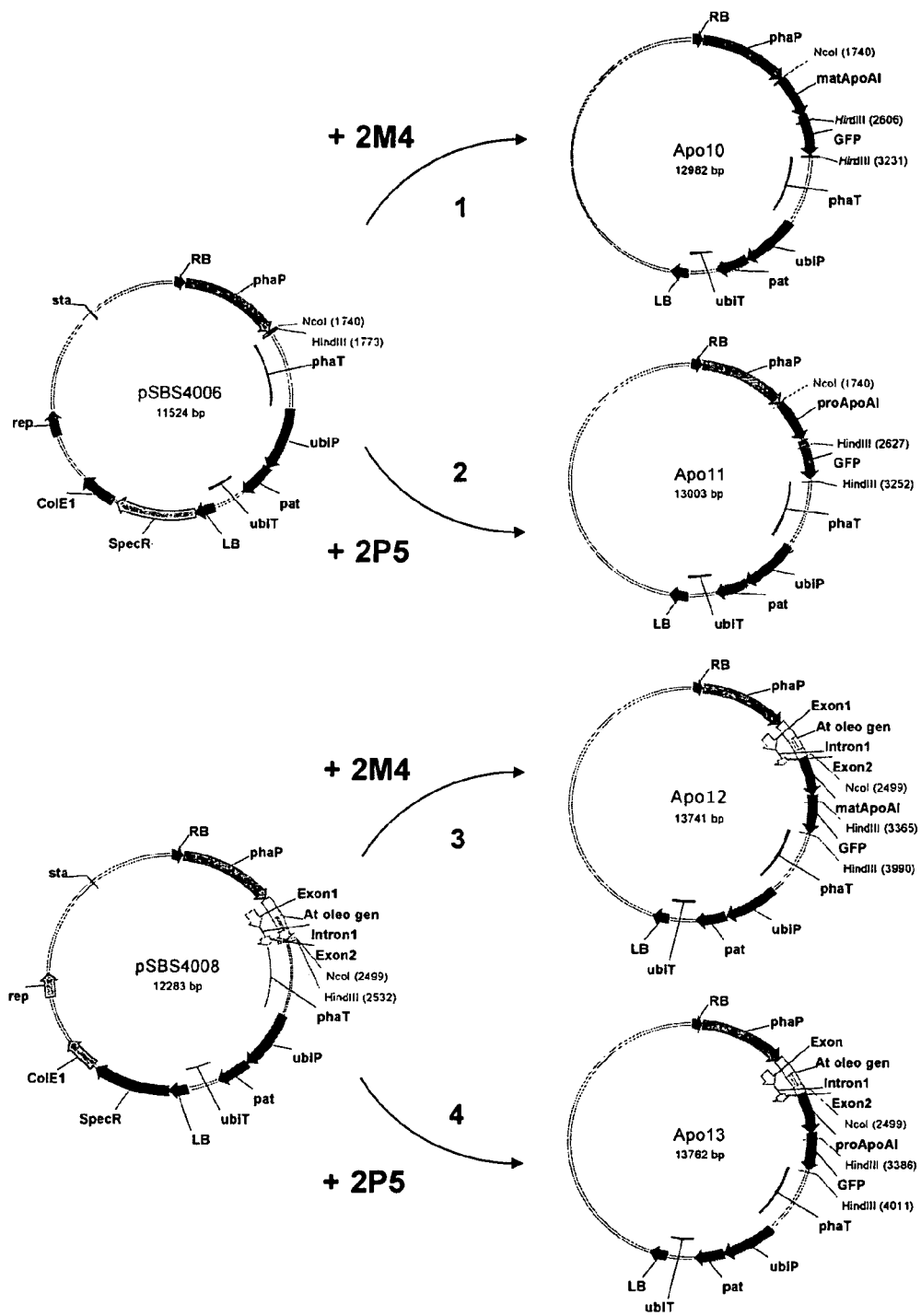
FIG. 3(C). Schematic drawing for the cloning strategy for creation of the binary vectors used to transform *Agrobacterium* EHA101 cells for seed-specific cytosolic and oil-body based targeting of Apo AI-GFP. Apo10 and Apo11 containing the mature and pro-Apo AI-GFP, respectively, targeted to the cytosol. Apo12 and Apo13 containing the pro- and mature Apo AI-GFP translational fusion, respectively, targeted to oil bodies.

Apo10 (SEQ ID NO:144) is a clone designed to express in a seed-specific manner which is constructed as per FIG. 3(A), 3(B) and 3(C). As seen in FIG. 2, the Apo10 clone consists of a seed-specific promoter and terminator (phaseolin) driving the expression of a fusion protein (SEQ ID NO:145) between mature Apo AI and GFP. To construct this clone forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID. NO:147) (5'-AAGCTTTCTAGACTGCAGTCATGACTTATTTGTATAG TTC-3') added PstI, XbaI and HindIII sites after the stop codon. The PCR fragment was ligated into the EcoRI cloning vector Topo (Invitrogen) creating plasmid G1 (FIG. 3(A)). Forward primer 1190 (SEQ ID NO:148) (5'-CCATGGggCGGCATTTCTGGCAGCAAGATG-3') amplifies the mature sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a in-frame translation fusion with GFP (Plasmid G1). The template for these primers was a pKS+ based vector (Strategene) containing the entire coding sequence for human Apo AI gene. The PCR fragment was ligated into the EcoRI site of the Topo cloning vector (Invitrogen) creating Plasmid M2. Plasmid M2 contained the mature sequence of Apo AI was cut with restriction enzymes NcoI and BamHI. Plasmid G'1 contains the GFP coding sequence and was cut with BamHI and XbaI (see FIG. 3(B)). The fragments of M2 and G'1 were ligated together into the NcoI and XbaI sites of the plasmid SBS2090 (see FIG. 3(B)) to create the plasmid 2M4. Plasmid 2M4 was cut with NcoI and HindIII to remove the Apo AI-GFP fusion cassette and the fragments were used subsequently to clone into the NcoI/HindIII sites of binary vector pSBS4006 (see FIG. 3(C)). Note that this plasmid contains the β-phaseolin promoter/terminator from *Phaseolus vulgaris* (Slightom et al., 1983, Proc. Natl. Acad. Sc. USA 80: 1897-1901) and a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*.

Apo11

Apo11 (SEQ ID NO:150) is a clone designed to express in a seed-specific manner which is constructed as per FIG. 3(A), 3(B) and 3(C). As seen in FIG. 2, the Apo11 clone consists of a seed-specific promoter and terminator (phaseolin) driving the expression of a fusion protein (SEQ ID NO:151) between pro-Apo AI and GFP. To construct this clone, forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID NO:147) (5'-AAGCTTTCTAGACTGCAGTCATGACTTATTTGTATAGTTC-3') added PstI, XbaI and HindIII sites after the stop codon. The PCR fragment was ligated into the EcoRI cloning vector Topo (Invitrogen) creating plasmid G1 (FIG. 3(A)). Forward primer 1191 (SEQ ID NO:152) (5'-CCATGGATGAACCCCCCCAGAGCCCCTG-3') amplifies the pro-sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a translation fusion with GFP (Plasmid G1). The template for these primers was a pKS+ based vector (Strategene) containing the entire coding sequence for human Apo AI gene. The PCR fragments were each separately ligated into the the EcoRI site of the Topo cloning vector (Invitrogen) creating Plasmid P2. Plasmid P2 contained the proApo AI sequence was cut with restriction enzymes NcoI and BamHI. Plasmid G'1 contains the GFP coding sequence and was cut with BamHI and XbaI (see FIG. 3(B)). The fragments of P2 and G'1 were ligated together into the NcoI and XbaI sites of the plasmid SBS2090 (see FIG. 3(B)) to create the plasmid 2P5. Plasmid 2P5 was cut with NcoI and HindIII to remove the pro-Apo AI-GFP fusion cassette and the fragments were used subsequently to clone into the NocI/HindIII sites binary vector pSBS4006 (see FIG. 3(C). Note that this plasmid contains the β-phaseolin promoter/terminator from *Phaseolus vulgaris* (Slightom et al., 1983, Proc. Natl. Acad. Sc. USA 80: 1897-1901) and a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*.

Apo12

Apo12 (SEQ ID NO:153) is a clone designed to express in a seed-specific manner which is constructed as per FIG. 3(A), 3(B) and 3(C). As seen in FIG. 2, the Apo12 clone consists of a seed-specific promoter and terminator (phaseolin) driving the expression of a fusion protein (SEQ ID NO:154) between an oleosin (van Rooijen, G. J., et al. Plant Mol. Biol. 18 (6), 1177-1179 (1992)), mature Apo AI and GFP. To construct this clone forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID NO:147) (5'-AAGCTTTCTAGACTGCAGTCATGACTTATTTGTATAGTTC-3') added PstI, XbaI and HindIII sites after the stop codon. The PCR fragment was ligated into the EcoRI cloning vector Topo (Invitrogen) creating plasmid G1 (FIG. 3(A)). Forward primer 1190 (SEQ ID NO: 148) (5'-CCATGGggCGGCATTTCTGGCAGCAAGATG-3') amplifies the mature sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a in-frame translation fusion with GFP (Plasmid G1). The template for these primers was a pKS+ based vector (Strategene) containing the entire coding sequence for human Apo AI gene. The PCR fragment was ligated into the EcoRI site of the Topo cloning vector (Invitrogen) creating Plasmid M2. Plasmid M2 contained the mature sequence of Apo AI was cut with restriction enzymes NcoI and BamHI. Plasmid G'1 contains the GFP coding sequence and was cut with BamHI and XbaI (see FIG. 3(B)). The fragments of M2 and G'1 were ligated together into the NcoI and XbaI sites of the plasmid SBS2090 (see FIG. 3(B)) to create the plasmid 2M4. Plasmid 2M4 was cut with NcoI and HindIII to remove the Apo AI-GFP fusion cassette and the fragments were used subsequently to clone into the NcoI/HindIII sites of binary vector pSBS4008 (see FIG. 3(C)). Note that this plasmid contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) for fusion with the Apo AI/GFP fusion. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*.

Apo13

Apo13 (SEQ ID NO:155) is a clone designed to express in a seed-specific manner which is constructed as per FIG. 3(A), 3(B) and 3(C). As seen in FIG. 2, the Apo13 clone consists of a seed-specific promoter and terminator (phaseolin) driving the expression of a fusion protein (SEQ ID NO:156) between oleosin, pro-Apo AI and GFP. To construct this clone, forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID NO:147) (5'-AAGCTTTCTAGACTGCAGTCATGACTTATTTGTATAGTTC-3') added PstI, XbaI and HindIII sites after the stop codon. The PCR fragment was ligated into the EcoRI cloning vector Topo (Invitrogen) creating plasmid G1 (FIG. 3(A)). Forward primer 1191 (SEQ ID NO:152) (5'-CCATGGATGAACCCCCCCAGAGCCCCTG-3') amplifies the pro-sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a translation fusion with GFP (Plasmid G1). The template for these primers was a pKS+ based vector (Strategene) containing the entire coding sequence for human Apo AI gene. The PCR fragments were each separately ligated into the EcoRI site of the Topo cloning vector (Invitrogen) creating Plasmid P2. Plasmid P2 contained the pro-Apo AI sequence was cut with restriction enzymes NcoI and BamHI. Plasmid G'1 contains the GFP coding sequence and was cut with BamHI and XbaI (see FIG. 3(B)). The fragments of P2 and G'1 were ligated together into the NcoI and XbaI sites of the plasmid SBS2090 (see FIG. 3(B)) to create the plasmid 2P5. Plasmid 2P5 was cut with NcoI and HindIII to remove the pro-Apo AI-GFP fusion cassette and the fragments were used subsequently to clone into the NocI/HindIII sites of binary vector pSBS4008 (see FIG. 3(C)). Note that this plasmid contains the β-phaseolin promoter/terminator from *Phaseolus vulgaris* (Slightom et al., 1983, Proc. Natl. Acad. Sc. USA 80: 1897-1901) controlling the expression of the *Arabidopsis oleosin* gene (van Rooijen G. J. et al. 1992, Plant Mol. Biol. 18 (6), 1177-1179) for fusion with the Apo AI/GFP fusion. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*.

Apo15

Figure 3D:
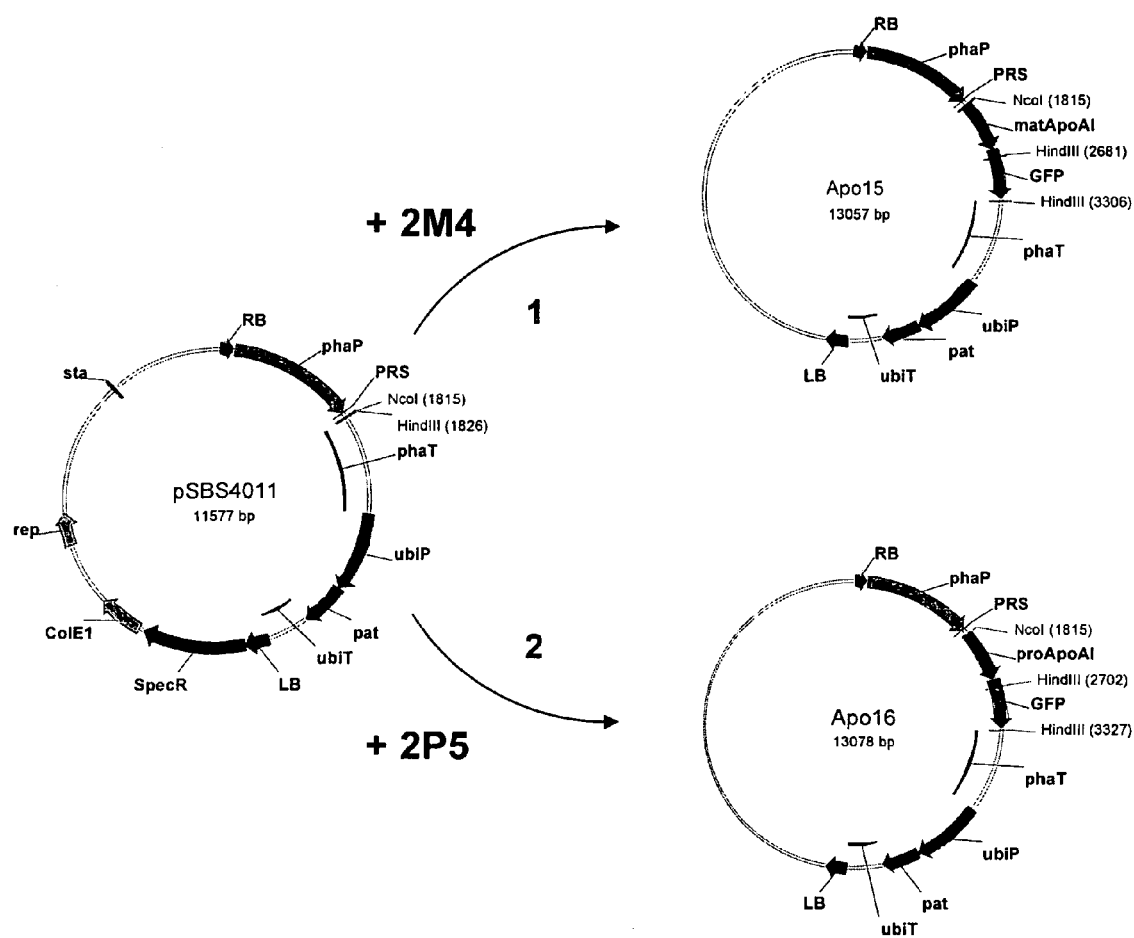
FIG. 3(D). Schematic drawing for the cloning strategy for creation of the binary vectors used to transform *Agrobacterium* EHA101 cells for seed-specific secretory pathway targeting of Apo AI-GFP. Apo15 and Apo16 containing the mature and pro-Apo AI-GFP translational fusion, respectively, targeted to the secretory pathway.

Apo15 (SEQ ID NO:157) is a clone designed to express in a seed-specific manner which is constructed as per FIG. 3(A), 3(B) and 3(D). As seen in FIG. 2, the Apo15 clone consists of a seed-specific promoter and terminator (phaseolin) driving the expression of a fusion protein (SEQ ID NO:158) between mature Apo AI and GFP. The fusion protein was targeted for expression through the secretory pathway using the tobacco pathogen related sequence (PRS) signal peptide (Sijmons et al., 1990, Bio/technology, 8: 217-221). To construct this clone forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID NO: 147) (5'-AAGCTTTCTAGACTGCAGTCATGACTTATTTGTATAG TTC-3') added PstI, XbaI and HindIII sites after the stop codon. The PCR fragment was ligated into the EcoRI cloning vector Topo (Invitrogen) creating plasmid G1 (FIG. 3(A)). Forward primer 1190 (SEQ ID NO:148) (5'-CCATGGggCGGCATTTCTGGCAGCAAGATG-3') amplifies the mature sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a in-frame translation fusion with GFP (Plasmid G1). The template for these primers was a pKS+ based vector (Strategene) containing the entire coding sequence for human Apo AI gene. The PCR fragment was ligated into the EcoRI site of the Topo cloning vector (Invitrogen) creating Plasmid M2. Plasmid M2 contained the mature sequence of Apo AI was cut with restriction enzymes NcoI and BamHI. Plasmid G'1 contains the GFP coding sequence and was cut with BamHI and XbaI (see FIG. 3(B)). The fragments of M2 and G'1 were ligated together into the NcoI and XbaI sites of the plasmid SBS2090 (see FIG. 3(B)) to create the plasmid 2M4. Plasmid 2M4 was cut with NcoI and HindIII to remove the Apo AI-GFP fusion cassette and the fragments were used subsequently to clone into the NcoI/HindIII sites of binary vector pSBS4011 (see FIG. 3(D)). Note that this plasmid contains the β-phaseolin promoter/terminator from *Phaseolus vulgaris* (Slightom et al., 1983, Proc. Natl. Acad. Sc. USA 80: 1897-1901) fused to the PRS signal peptide. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684)) for transformation into *Agrobacterium*.

Apo16

Apo16 (SEQ ID NO:159) is a clone designed to express in a seed-specific manner which is constructed as per FIGS. 3(A), 3(B) and 3(D). As seen in FIG. 2, the Apo16 clone consists of a seed-specific promoter and terminator (phaseolin) driving the expression of a fusion protein (SEQ ID NO:160) between pro-Apo AI and GFP. The fusion protein was targeted for expression through the secretory pathway using the tobacco pathogen related sequence (PRS) signal peptide (Sijmons et al., 1990, Bio/technology, 8: 217-221). To construct this clone, forward primer 1186 (SEQ ID NO:146) (5'-GGATCCCCtTGGCTAGTAAAGG-3') removed a NcoI site from the start of GFP (template derived from the vector pVS-GFP). Reverse primer 1187 (SEQ ID NO: 147) (5'-AAGCTTTCTAGACTGCAGTCATGACTTATTTGTATAG TTC-3') added PstI, XbaI and HindIII sites after the stop codon. The PCR fragment was ligated into the EcoRI cloning vector Topo (Invitrogen) creating plasmid G1 (FIG. 3(A)). Forward primer 1191 (SEQ ID NO:152) (5'-CCATGGAT-GAACCCCCCCAGAGCCCCTG-3') amplifies the pro-sequence of Apo AI and adds a NcoI site to the start of gene. Reverse primer 1189 (SEQ ID NO:149) (5'-GGATCCcCTGGGTGTTGAGCTTCTTAGTG-3') removes the stop codon of the gene and adds a BamHI site to assist in creating a translation fusion with GFP (Plasmid G1). The template for these primers was a pKS+ based vector (Strategene) containing the entire coding sequence for human Apo AI gene. The PCR fragments were each separately ligated into the the EcoRI site of the Topo cloning vector (Invitrogen) creating Plasmid P2. Plasmid P2 contained the pro-Apo AI sequence was cut with restriction enzymes NcoI and BamHI. Plasmid G'1 contains the GFP coding sequence and was cut with BamHI and XbaI (see FIG. 3(B)). The fragments of P2 and G'1 were ligated together into the NcoI and XbaI sites of the plasmid SBS2090 (see FIG. 3(B)) to create the plasmid 2P5. Plasmid 2P5 was cut with NcoI and HindIII to remove the pro-Apo AI-GFP fusion cassette and the fragments were used subsequently to clone into the NcoI/HindIII sites of binary vector pSBS4011 (see FIG. 3(D)). Note that this plasmid contains the β-phaseolin promoter/terminator from *Phaseolus vulgaris* (Slightom et al., 1983, Proc. Natl. Acad. Sc. USA 80: 1897-1901) fused to the PRS signal peptide. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*.

Apo17

Figure 4A:
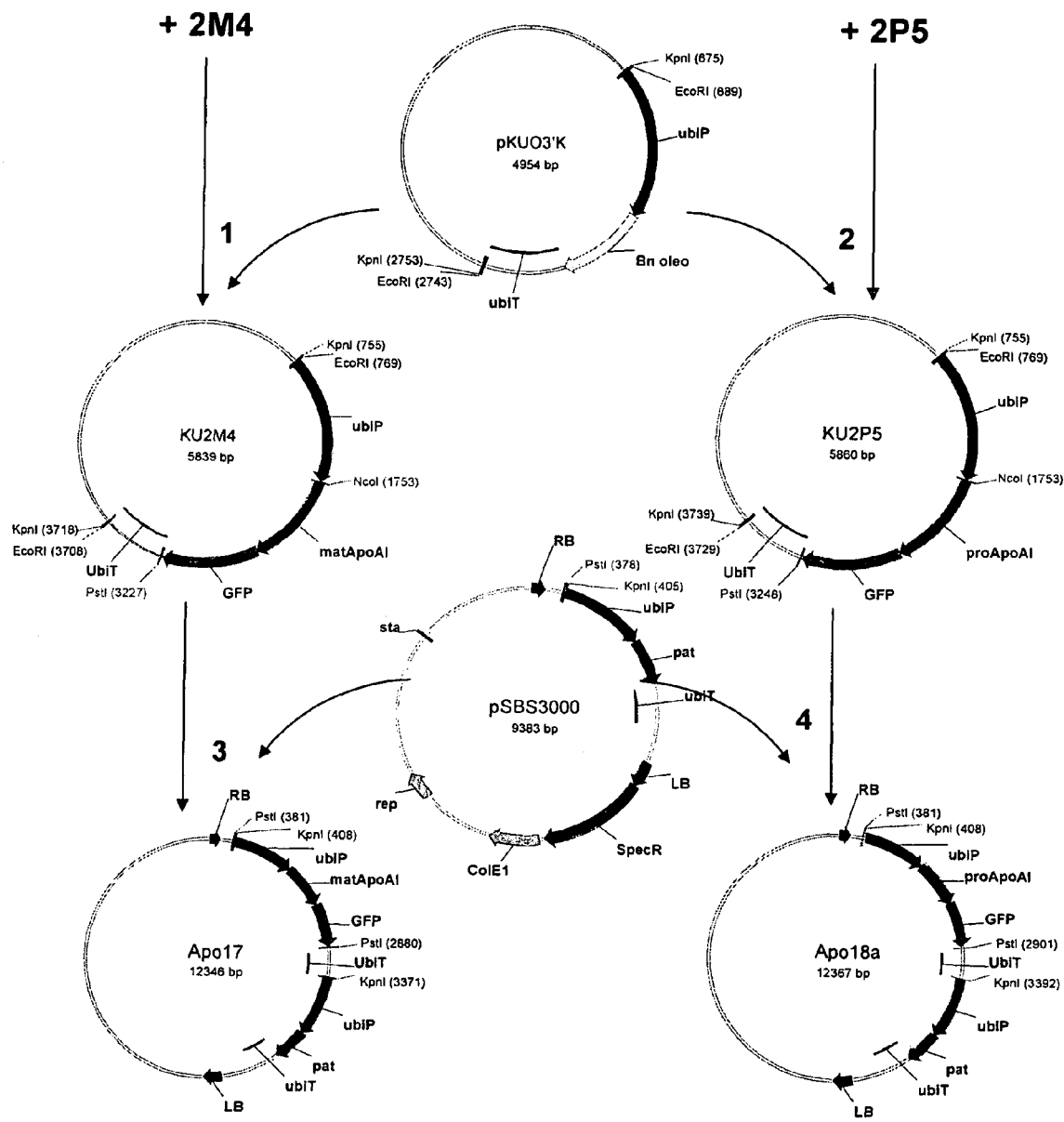
FIG. 4(A). Schematic drawing for the cloning strategy for creation of the binary vectors used to transform *Agrobacterium* EHA101 cells for constitutive cytosolic targeting of Apo AI-GFP. Apo17 and Apo18a containing the mature and pro-Apo AI-GFP translational fusion, respectively, targeted to the cytosol.

Apo17 (SEQ ID NO:161) is clone designed to express in a constitutive manner which is constructed as per FIG. 4(A). As seen in FIG. 2, the Apo17 clone consists of a consititutive promoter and terminator (ubiquitin) driving the expression of a fusion protein (SEQ ID NO:162) between Apo AI and GFP. To construct this clone, plasmid 2M4 (see FIG. 3(B)) was cut with NcoI and PstI to remove the Apo AI-GFP fusion cassette and the fragment was ligated into the NcoI and PstI sites of the plasmid pKUO3' to create plasmid KU2M4. The pKUO3' plasmid contains a *Brassica napus* oleosin gene which is removed when the vector is cut with NcoI and PstI resulting in the Apo AI/GFP fusion construct under the control of a parsley ubiquitin promoter and ubiqutin terminator (Kawalleck, P. et al., 1993, Plant Mol. Biol. 21: 673-684). The KU2M4 plasmid was cut with KpnI and ligated into the KpnI site of the binary vector SBS3000 (FIG. 4. Note that this plasmid contains a pat gene conferring host plant phosphinothricine resistance (Wohlleben et al., 1988, Gene 70: 25-37)

driven by the ubiquitin promoter/terminator from *Petroselinum crispum* (Kawalleck et al., 1993, Plant. Mol. Bio., 21: 673-684) for transformation into *Agrobacterium*. The Apo17 clone contains a mature Apo AI-GFP translational fusion and is targeted to the cytosol.

Apo18a

Apo18a (SEQ ID NO:163) is clone designed to express in a constitutive manner which is constructed as per FIG. 4. As seen in FIG. 2, the Apo18a clone consists of a consititutive promoter and terminator (ubiquitin) driving the expression of a fusion protein (SEQ ID NO:164) between pro-Apo AI and GFP. To construct this clone, plasmid 2P5 (see FIG. 3(B)) was cut with NcoI and PstI to remove the pro-Apo AI-GFP fusion cassette and the fragment was ligated into the NcoI and PstI sites of the plasmid pKUO3' to create plasmid KU2P5. The pKUO3' plasmid contains a *Brassica napus* oleosin gene which is removed when the vector is cut with NcoI and PstI resulting in the pro-Apo AI/GFP fusion construct under the control of a parsley ubiquitin promoter and ubiqutin terminator (Kawalleck, P. et al., 1993, Plant Mol. Biol. 21: 673-684). The KU2P5 plasmid was cut with KpnI and ligated into the KpnI site of the binary vector SBS3000 (FIG. 4. Note that this plasmid contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. The Apo18a clone contains a pro-Apo AI-GFP translational fusion and is targeted to the cytosol.

Apo18b

Figure 4B:
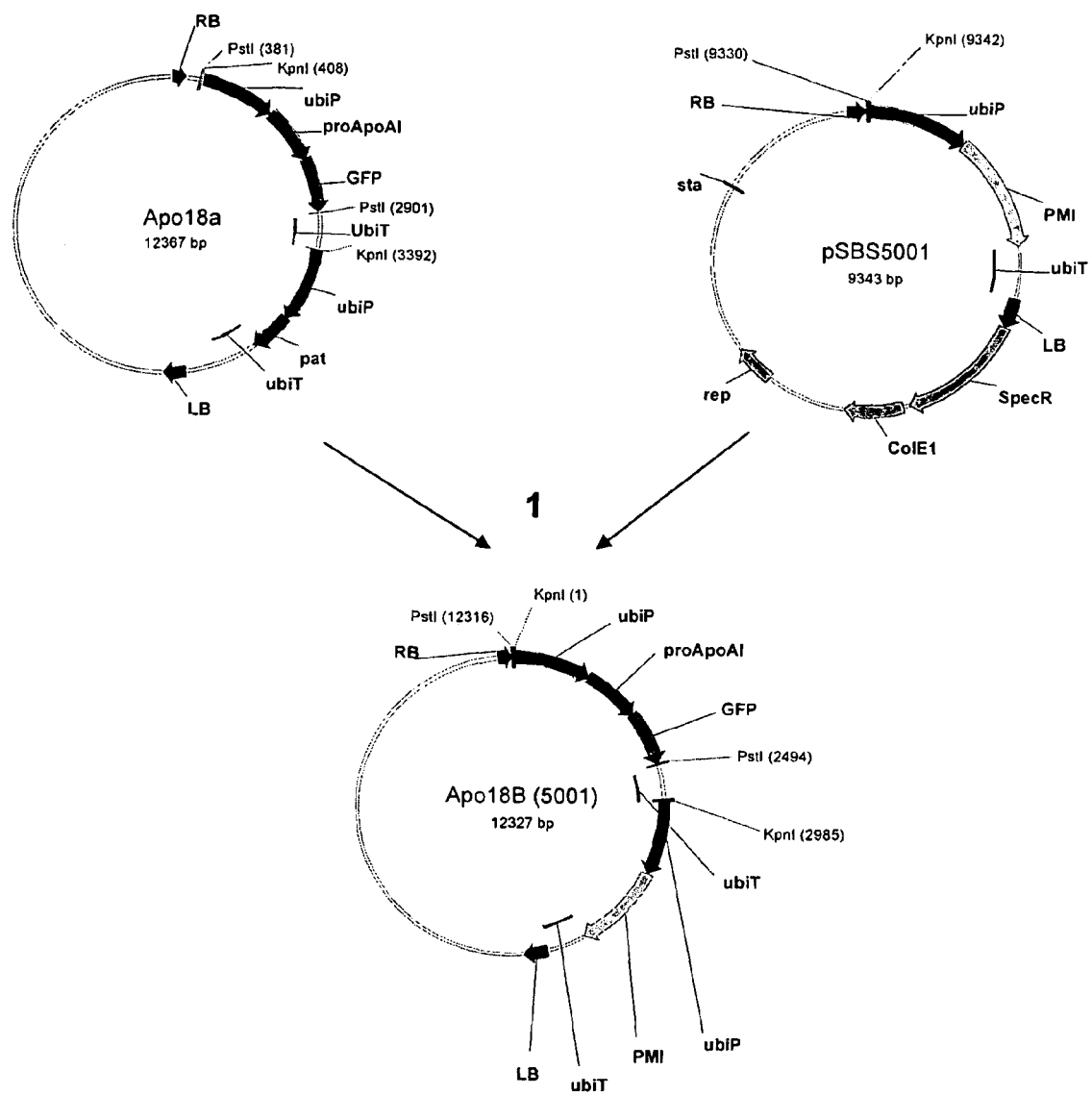
FIG. 4(B). Schematic drawing for the cloning strategy for constitutive cytosolic targeting of Apo AI-GFP. Apo18b containing the pro-Apo AI-GFP translational fusion targeted to the cytosol.

Apo18b (SEQ ID NO:163) is clone designed to express in a constitutive manner which is constructed as per FIG. 4(B). As seen in FIG. 2, the Apo18b clone consists of a constitutive promoter and terminator (ubiquitin) driving the expression of a fusion protein (SEQ ID NO:164) between pro-Apo AI and GFP. Note that clones Apo18a and Apo18b both consist have a constitutive promoter (ubiquitin) driving the expression a fusion protein (SEQ ID NO:164) between pro-Apo AI and GFP. The difference between the 2 clones is that Apo18a is inserted into the KpnI site of binary vector pSBS3000 (which contains the pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. In contrast, Apo18b is inserted into the KpnI site of binary vector pSBS5001 (which contains the pmi gene (Miles et al., 1984, Gene 21: 41-48), encoding for phosphomannose isomerase which allows for positive selection on mannose containing selection media. The pmi gene is under the control of the ubiquitin promoter/terminator from *Petroselinum crispum* (Kawalleck et al., 1993, Plant. Mol. Bio., 21: 673-684) for transformation into *Agrobacterium*. To construct this clone, the Apo18a binary vector was cut with KpnI remove the pro-Apo AI-GFP fusion cassette and the fragment was ligated into the KpnI site of the plasmid SBS5001 for expression in *Agrobacterium*. The Apo18b clone contains a pro-Apo AI-GFP translational fusion and is targeted to the cytosol.

Apo19

Figure 5A:
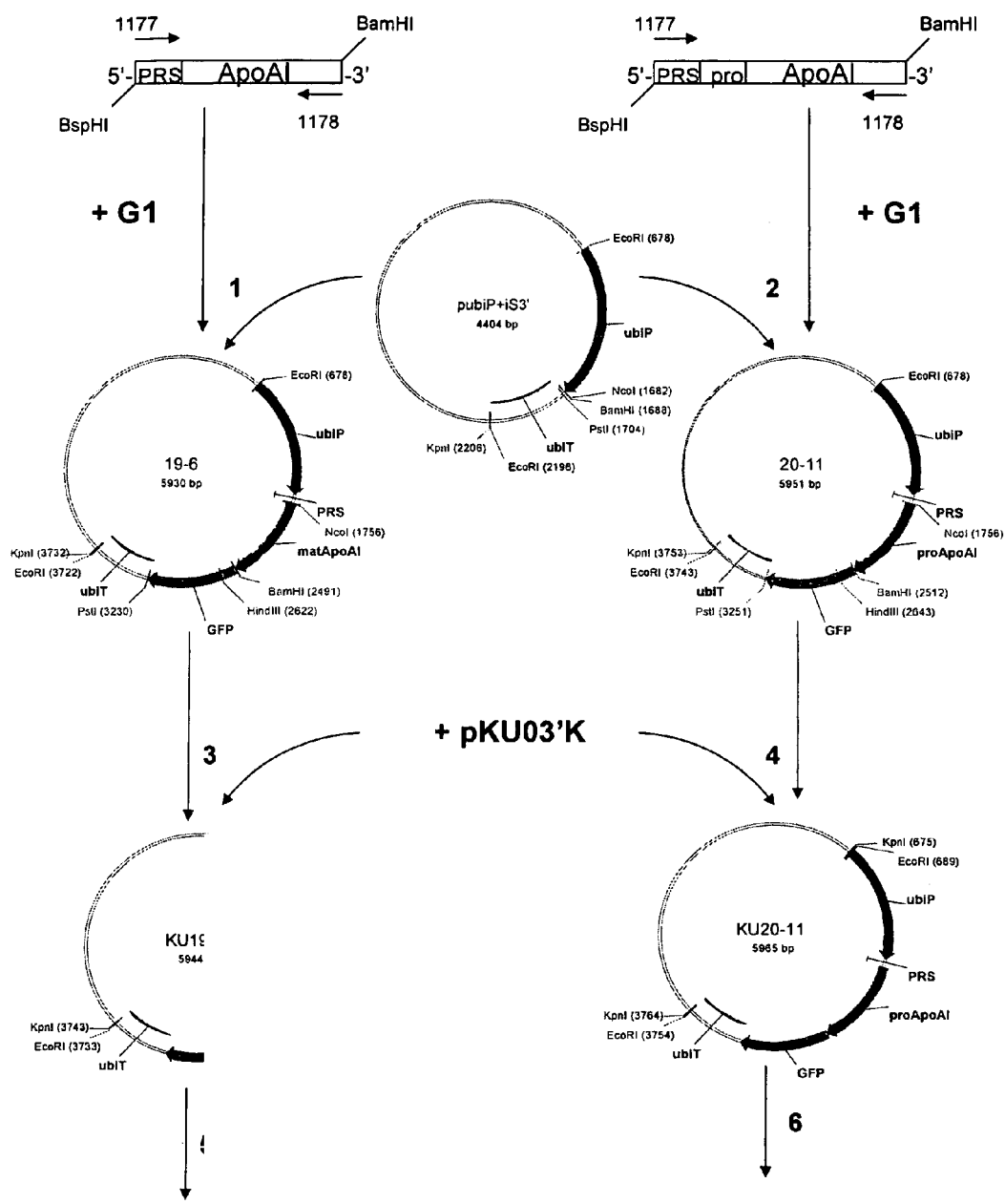
FIG. 5(A). Schematic drawing for the cloning strategy for the pro- and mature coding regions of Apo AI and constitutive expression of Apo AI-GFP translational fusion protein.
Figure 5B:
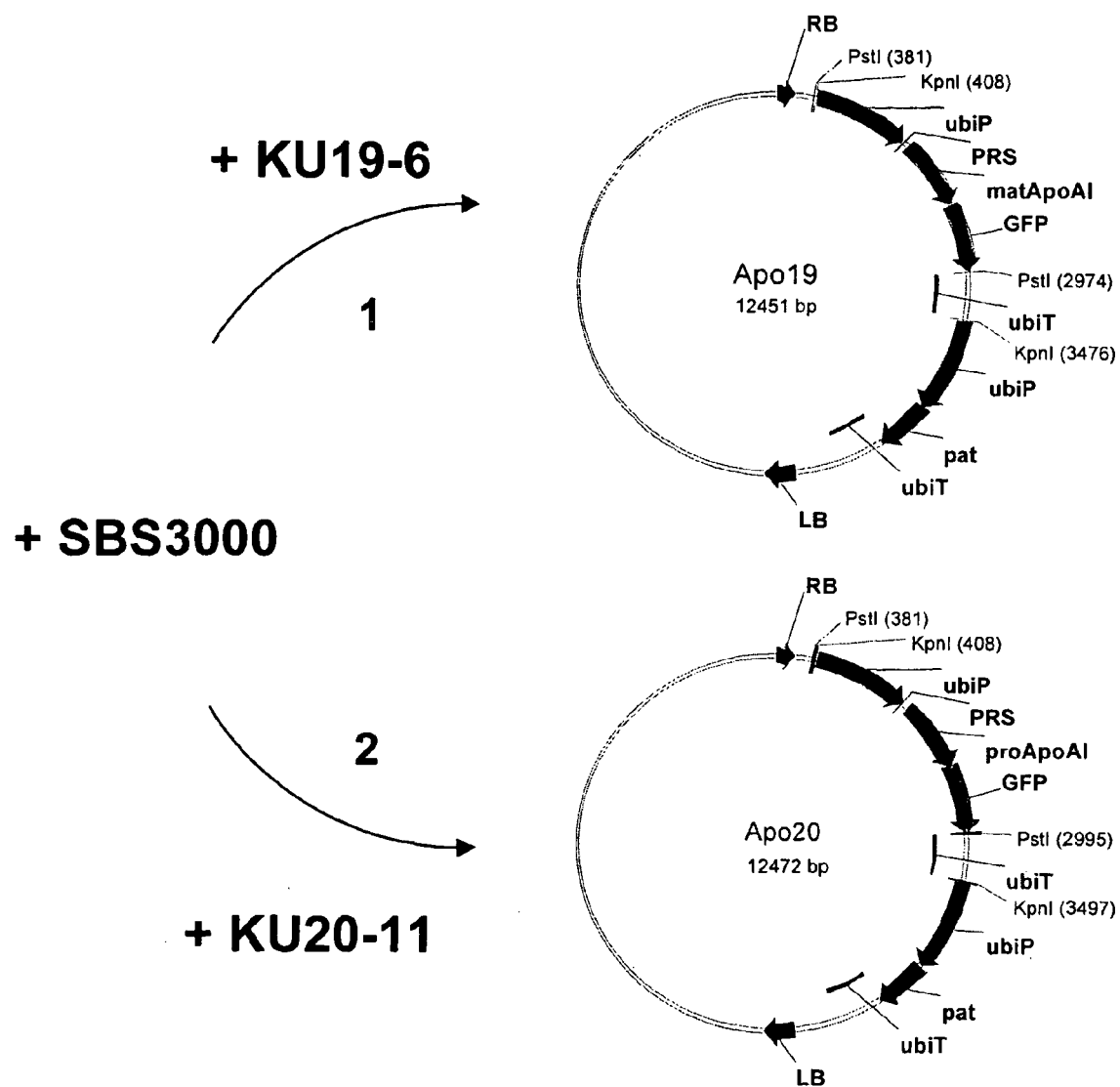
FIG. 5(B). Schematic drawing for the cloning strategy for the creation of binary vectors used to transform *Agrobacterium* EHA101 cells for constitutive secretory pathway targeting of Apo AI-GFP. Apo19 and Apo20 containing the mature and pro-Apo AI-GFP translational fusion, respectively, targeted to the secretory pathway.

Apo19 (SEQ ID NO:165) is clone designed to express in a constitutive manner which is constructed as per FIGS. 5(A) and 5(B). As seen in FIG. 2, the Apo19 clone consists of a constititutive promoter and terminator (ubiquitin) driving the expression of a fusion protein (SEQ ID NO:166) between Apo AI and GFP. The fusion protein was targeted for expression through the secretory pathway using the tobacco pathogen related sequence (PRS) signal peptide (Sijmons et al., 1990, Bio/technology, 8: 217-221). To construct this clone, Apo15 is used as a template. Forward primer 1177 (SEQ ID NO:167) (5'-GCAGCATTCATGAACTTCCT-TAAGTCTTTCC-3') amplifies the start of the plant presequence (PRS) which contains a BspHI site at the start codon. Reverse primer 1178 (SEQ ID NO:168) (5'-GGTGGTGGATC-CcCTGGGTGTTGAGCTTCTTAGTG-3') removes the stop codon of the gene and adds a BamHI site to assist in creating an in-frame translation fusion with GFP. Extra bases were left on the ends of both primers to facilitate restriction enzyme digestion. The G1 plasmid (see FIG. 3(A)) was digested with BamHI and PstI for ligation into pubiP+iS3' which contains the ubiquitin promoter and terminator from *Petroselinum crispum* (Kawalleck et al., 1993, Plant. Mol. Bio., 21: 673-684). The PRS-Apo AI PCR fragment was digested with BspHI and BamHI and ligated with the G1 fragment into the plasmid pubiP+iS3' to create plasmid 19-6. Plasmid 19-6 was digested with EcoRI to remove the expression cassette and the cassette was then ligated into the plasmid pKUO3'K (FIG. 4(A)) between the EcoRI sites (removing the existing cassette), creating plasmid KU19-6. KU19-6 was digested with KpnI and the fragment was ligated into the KpnI sites of the plasmid SBS3000 (FIG. 5(B)). Note that this plasmid contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium. The Apo*19 clone contains a mature Apo AI-GFP translational fusion, respectively, targeted to the secretory pathway.

Apo20

Apo20 (SEQ ID NO:169) is clone designed to express in a constitutive manner which is constructed as per FIGS. 5(A) and 5(B). As seen in FIG. 2, the Apo20 clone consists of a consititutive promoter and terminator (ubiquitin) driving the expression of a fusion protein (SEQ ID NO:170) between pro-Apo AI and GFP. The fusion protein was targeted for expression through the secretory system using the tobacco pathogen related sequence (PRS) signal peptide (Sijmons et al., 1990, Bio/technology, 8: 217-221). To construct this clone, Apo16 is used as a template. Forward primer 1177 (SEQ ID NO:167) (5'-GCAGCATTCATGAACTTCCT-TAAGTCTTTCC-3') amplifies the start of the plant presequence (PRS) which contains a BspHI site at the start codon. Reverse primer 1178 (SEQ ID NO:168) (5'-GGTGGTG-GATCCcCTGGGTGTTGAGCTTCTTAGTG-3') removes the stop codon of the gene and adds a BamHI site to assist in creating an in-frame translation fusion with GFP. Extra bases were left on the ends of both primers to facilitate restriction enzyme digestion. The G1 plasmid (see FIG. 3(A)) was digested with BamHI and PstI for ligation into pubiP+iS3' which contains the ubiquitin promoter and terminator from *Petroselinum crispum* (Kawalleck et al., 1993, Plant. Mol. Bio., 21: 673-684). The PRS-pro-Apo AI PCR fragment was digested with BspHI and BamHI and ligated with the G1 fragment into the plasmid pubiP+iS3' to create plasmid 20-11. Plasmid 20-11 was digested with EcoRI to remove the expression cassette and the cassette was then ligated into the plasmid pKUO3'K (FIG. 4(A)) between the EcoRI sites (removing the existing cassette), creating plasmid KU20-11. KU20-11 was digested with KpnI and the fragment was ligated into the KpnI sites of the plasmid SBS3000 (FIG. 5(B). Note that this plasmid contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. The Apo20 clone contains a pro-Apo AI-GFP translational fusion, respectively, targeted to the secretory pathway.

Apo21

Figure 6:
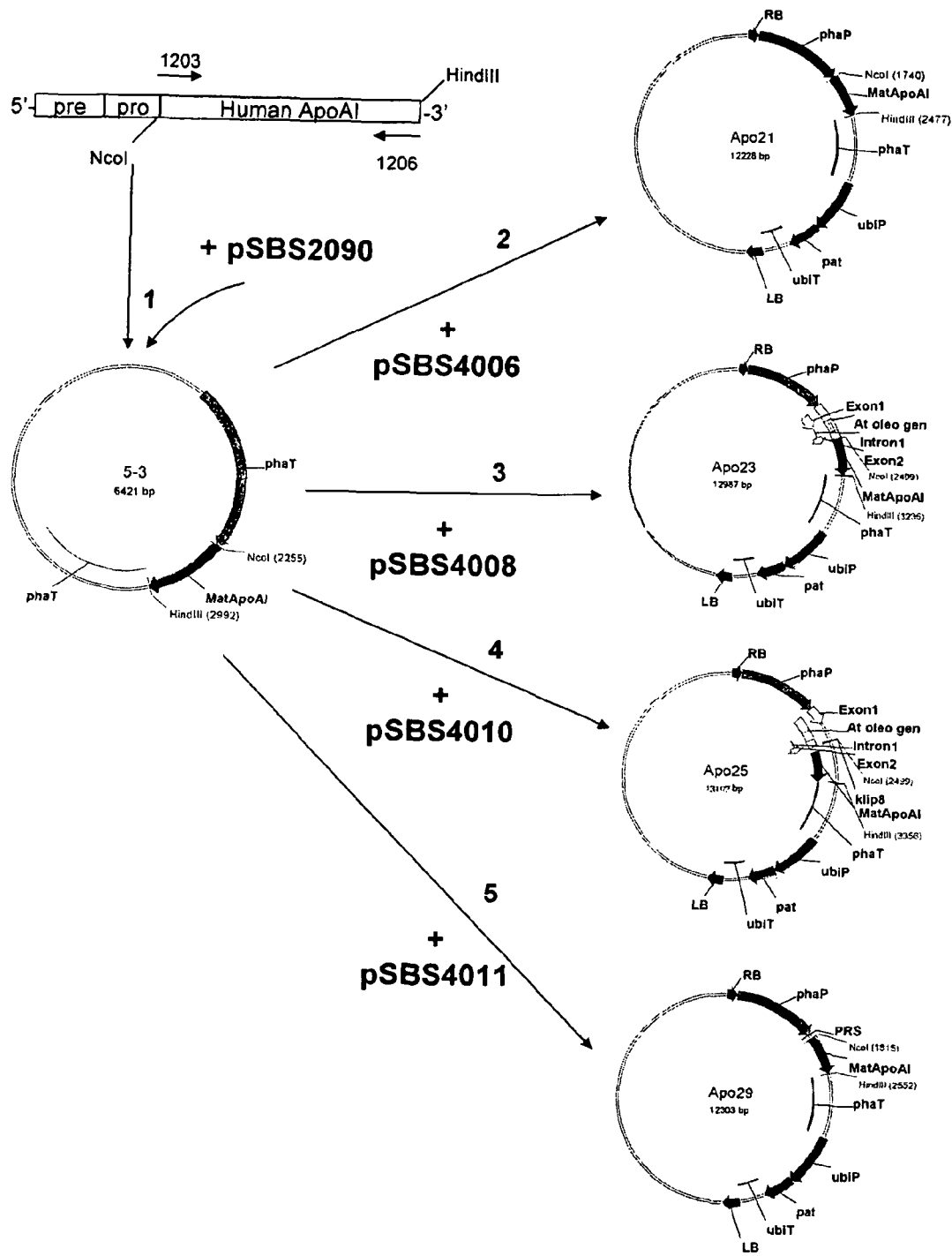
FIG. 6. Schematic drawing for the cloning strategy for the mature form of the coding region of Apo AI. Apo21 for seed-specific targeting to the cytosol, Apo23 for seed-specific targeting to oil bodies, Apo25 for seed-specific targeting to oil-bodies and purification with cleavage sequence klip8 and Apo29 for seed-specific targeting to the secretory pathway.

Apo21 (SEQ ID NO:171) is a seed-preferred clone which is constructed as per FIG. 6. As seen in FIG. 2, the Apo21 clone consists of a seed-preferred promoter and terminator (phaseolin) driving the expression of Apo AI (SEQ ID NO:172). To construct this clone forward primer 1203 (SEQ ID NO:173) (5'-GCAGCACCATGGATGAACCCCCCCA-GAGCCCCTG-3') adds a NcoI site to the start of mature Apo AI. Reverse primer 1206 (SEQ ID NO: 174 (5'-GTGGT-GAAGCTTTCACTGGGTGTTGAGCTTCT-TAGTGTACTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 creating plasmid 5-3 (FIG. 6). Plasmid 5-3 was digested with NcoI and HindIII and the Apo AI fragment was ligated into the NcoI/HindIII sites of SBS4006 (FIG. 3(C)). SBS4006 contains the β-phaseolin promoter/terminator from *Phaseolus vulgaris* (Slightom et al., 1983, Proc. Natl. Acad. Sc. USA 80: 1897-1901) and a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. Apo21 is a clone for seed-specific targeting of Apo AI to the cytosol.

Apo22

Figure 7:
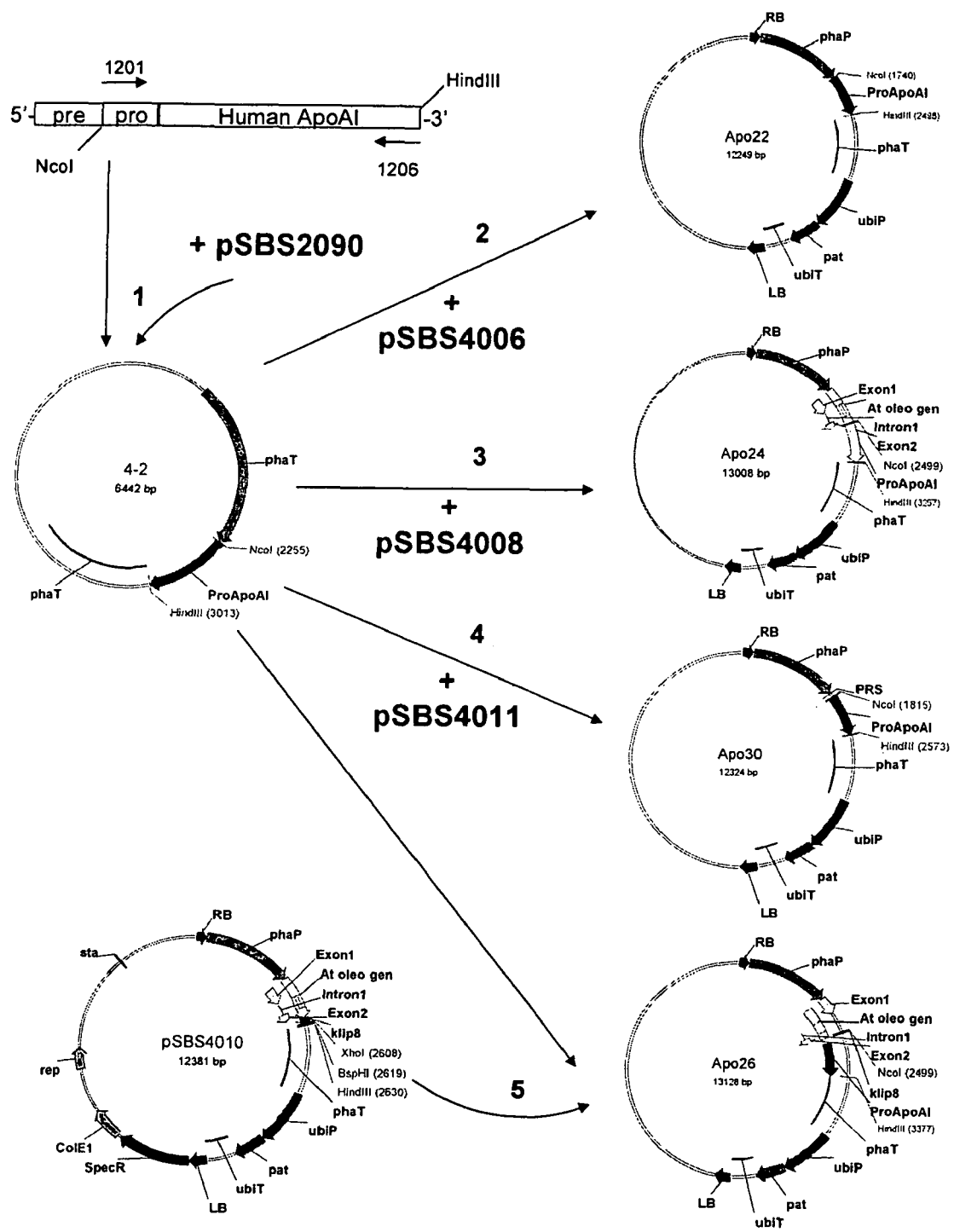
FIG. 7. Schematic drawing for the cloning strategy for the pro-form of the coding region of Apo AI. Apo22 for seed-specific targeting to the cytosol, Apo24 for seed-specific targeting to oil bodies, Apo30 for seed-specific targeting to the secretory pathway and Apo26 for seed-specific targeting to oil-bodies and purification with cleavage sequence klip8.

Apo22 (SEQ ID NO:175) is a seed-preferred clone which is constructed as per FIG. 7. As seen in FIG. 2, the Apo22 clone consists of a seed-preferred promoter and terminator (phaseolin) driving the expression of pro-Apo AI (SEQ ID NO:176). To construct this clone forward primer 1201 (SEQ ID NO: 177) (5'-GCAGCACCATGGggCGGCATTTCTG-GCAGCAAGATG-3') adds an NcoI site to the start of pro-Apo AI. Reverse primer 1206 (SEQ ID NO:174) (5'-GTG-GTGAAGCTTTCACTGGGTGTTGAGCTTCTTAGTGTA CTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 (FIG. 3(B)) creating plasmid 4-2 (FIG. 7). Plasmid 4-2 was digested with NcoI and HindIII and the pro-Apo AI fragment was ligated into the NcoI/HindIII sites of SBS4006 (FIG. 3(C)). SBS4006 contains the β-phaseolin promoter/terminator from *Phaseolus vulgaris* (Slightom et al., 1983, Proc. Natl. Acad. Sc. USA 80: 1897-1901) and a pat gene conferring host plant phosphinothricine resistance (Wohlleben et al., 1988, Gene 70: 25-37) driven by the ubiquitin promoter/terminator from Petroselinum crispum (Kawalleck et al., 1993, Plant. Mol. Bio., 21: 673-684)) for transformation into *Agrobacterium*. Apo22 is a clone for seed-specific targeting of pro-Apo AI to the cytosol.

Apo23

Apo23 (SEQ ID NO:178) is a seed-preferred clone which is constructed as per FIG. 6. As seen in FIG. 2, the Apo23 clone consists of a seed-preferred promoter and terminator (phaseolin) driving the expression of oleosin/Apo AI (SEQ ID NO:179). To construct this clone forward primer 1203 (SEQ ID NO:173) (5'-GCAGCACCATGGATGAAC-CCCCCCAGAGCCCCTG-3') adds an NcoI site to the start of mature Apo AI. Reverse primer 1206 (SEQ ID NO:174) (5'-GTGGTGAAGCTTTCACTGGGTGT-TGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 creating plasmid 5-3 (FIG. 6). Plasmid 5-3 was digested with NcoI and HindIII and the Apo AI fragment was ligated into the NcoI/HindIII sites of SBS4008 (FIG. 3(C)). SBS4008 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684)) for transformation into *Agrobacterium*. Apo23 is a clone for seed-specific targeting of oleosin/Apo AI to the oil bodies.

Apo24

Apo24 (SEQ ID NO:180) is a seed-preferred clone which is constructed as per FIG. 7. As seen in FIG. 2, the Apo24 clone consists of a seed-preferred promoter and terminator (phaseolin) driving the expression of oleosin/pro-Apo AI (SEQ ID NO:181). To construct this clone forward primer 1201 (SEQ ID NO:177) (5'-GCAGCACCATGGggCG-GCATTTCTGGCAGCAAGATG-3') adds an NcoI site to the start of pro-Apo AI. Reverse primer 1206 (SEQ ID NO:174) (5'-GTGGTGAAGCTTTCACTGGGTGT-TGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 creating plasmid 4-2 (FIG. 7). Plasmid 4-2 was digested with NcoI and HindIII and the pro-Apo AI fragment was ligated into the NcoI/HindIII sites of SBS4008 (FIG. 3(C)). SBS4008 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo24 is a clone for seed-specific targeting of oleosin/pro-Apo AI to the oil bodies.

Apo25

Apo25 (SEQ ID NO:182) is a seed-preferred clone which is constructed as per FIG. 6. As seen in FIG. 2, the Apo25 clone consists of a seed-preferred promoter and terminator (phaseolin) driving the expression of oleosin/klip8/met/Apo AI (SEQ ID NO:183). This construct has a klip8 cleavage sequence (SEQ ID NO:143) to facilitate cleavage of the fusion protein with chymosin. To construct this clone forward primer 1203 (SEQ ID NO:173) (5'-GCAGCACCATGGAT-GAACCCCCCCAGAGCCCCTG-3') adds an NcoI site to the start of mature Apo AI. Reverse primer 1206 (SEQ ID NO:174) (5'-GTGGTGAAGCTTTCACTGGGTGT-TGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 (FIG. 3(B)) creating plasmid 5-3 (FIG. 6). Plasmid 5-3 was digested with NcoI and HindIII and the Apo AI fragment was ligated into the NcoI/HindIII sites of SBS4010 (FIG. 7). SBS4010 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a klip8 cleavage site. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. Apo25 is a clone for seed-specific targeting of oleosin/klip8/met/Apo AI to the oil bodies and purification using the klip8 cleavage sequence.

Apo26

Apo26 (SEQ ID NO:184) is a seed-preferred clone which is constructed as per FIG. 7. As seen in FIG. 2, the Apo26 clone consists of a seed-preferred promoter and terminator (phaseolin) driving the expression of oleosin/klip8/met/pro-Apo AI (SEQ ID NO:185). This construct has a klip8 cleavage sequence (SEQ ID NO:143) to facilitate cleavage of the fusion protein with chymosin. To construct this clone forward primer 1201 (SEQ ID NO:177) (5'-GCAGCAC-CATGGggCGGCATTTCTGGCAGCAAGATG-3') adds an NcoI site to the start of pro-Apo AI. Reverse primer 1206 (SEQ ID NO:174) (5'-GTGGTGAAGCTTTCACTGGGT-GTTGAGCTTCTTAGTGTACTCCTcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 (FIG. 3(B)) creating plasmid 4-2 (FIG. 7). Plasmid 4-2 was digested with NcoI and HindIII and the pro-met-Apo AI fragment was ligated into the BspHI/HindIII sites of SBS4010 (FIG. 7). SBS4010 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a klip8 cleavage site. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo26 is a clone for seed-specific targeting of oleosin/klip8/met/pro-Apo AI to the oil bodies and purification using the klip8 cleavage sequence.

Apo27

Figure 8A:
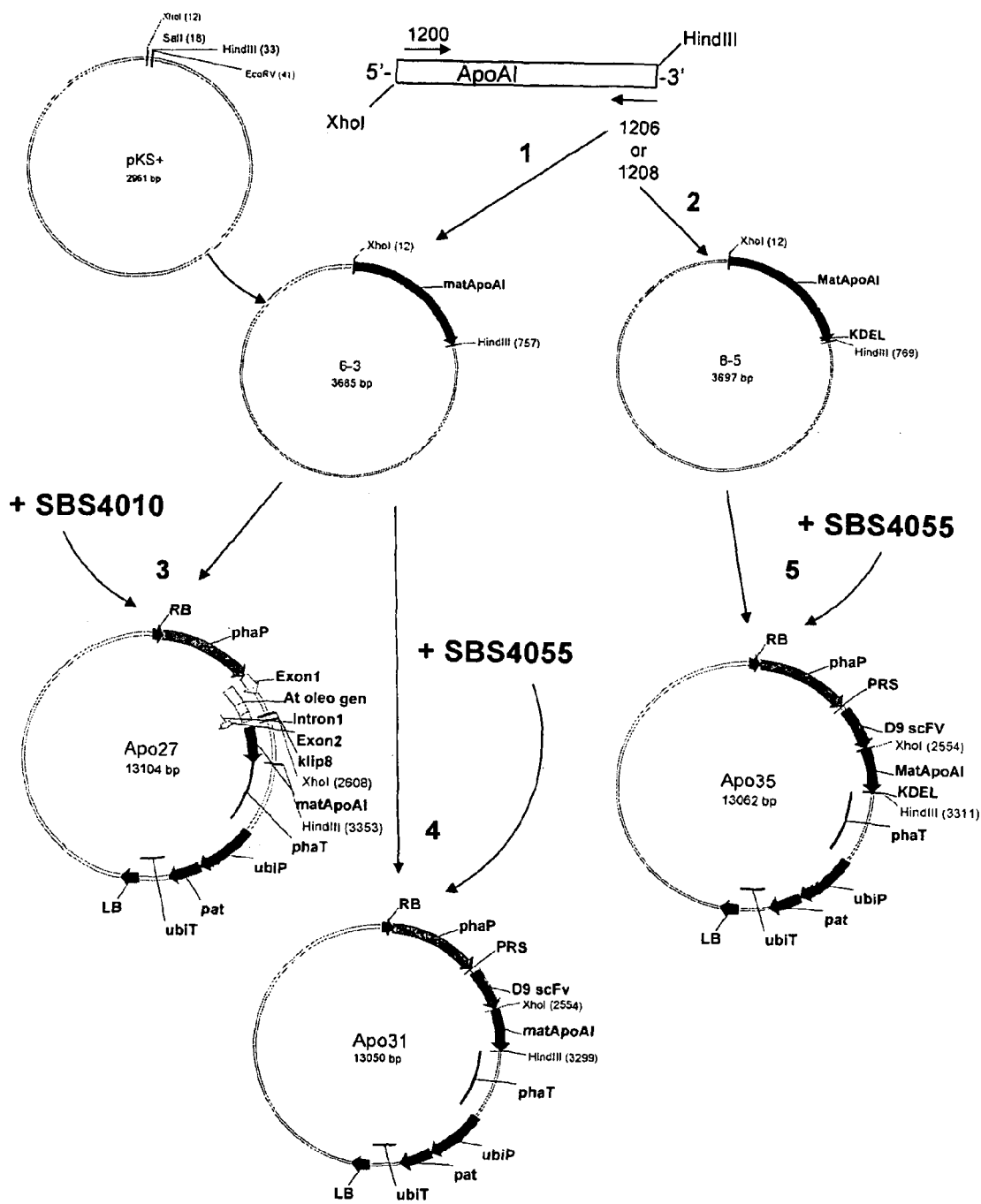
FIG. 8(A). Schematic drawing for the cloning strategy for the pro-form of the coding region of Apo AI with the internal XhoI sites removed and contains a KDEL signal peptide. Apo27 for seed-specific targeting to the oil bodies as an in-frame fusion with oleosin. Apo31 and Apo35 both targeted to the secretory pathway, with Apo31 and Apo35 fused in-frame with the oleosin antibody D9, and Apo35 accumulating in the endoplasmic reticulum due to a KDEL signal peptide.

Apo27 (SEQ ID NO:186) is a seed-preferred clone which is constructed as per FIG. 8(A). As seen in FIG. 2, the Apo27 clone consists of a seed-preferred promoter and terminator (phaseolin) driving the expression of oleosin/klip8/Apo AI (SEQ ID NO:187). Apo27 was targeted for expression to the oil bodies using the *Arabidopsis* oleosin sequence (van Rooijen G. J. et al. 1992, Plant Mol. Biol. 18 (6), 1177-1179) and has a klip8 cleavage sequence (SEQ ID NO:143) to facilitate cleavage of the fusion protein with chymosin. To construct this clone forward primer 1200 (SEQ ID NO:188) (5'-GCAG-CACTCGAGcaagttcCGGCATTTCTGGCAGCAAGA-3') adds an XhoI site and extra nucleotides to facilitate in-frame cloning into the klip8 (SEQ ID NO:143) cleavage sequence to the start of pro-Apo AI. Reverse primer 1206 (SEQ ID NO:174) (5'-GTGGTGAAGCTTTCACTGGGTGT-TGAGCTTCTTAGTGTACTCCTcAGA GCG-3') adds a HindIII site after the stop codon and adds a silent mutation to remove the second XhoI site. The template for these primers was the Apo33 plasmid which contains the pro-form of Apo AI without internal XhoI sites and additional Met residue. The PCR fragments were cut with XhoI and ligated into the XhoI/EcoRV sites of pKS+ creating the plasmids 6-3. Plasmid 6-3 was cut with XhoI and HindIII and ligated into the XhoI/HindIII sites of binary bector SBS4010 (FIG. 7.) Note SBS4010 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a klip8 cleavage site. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684)) for transformation into *Agrobacterium*. Apo27 is a clone for for seed-specific targeting of Apo AI to oil bodies and purification with cleavage sequence klip8.

Apo27M

Figure 8B:
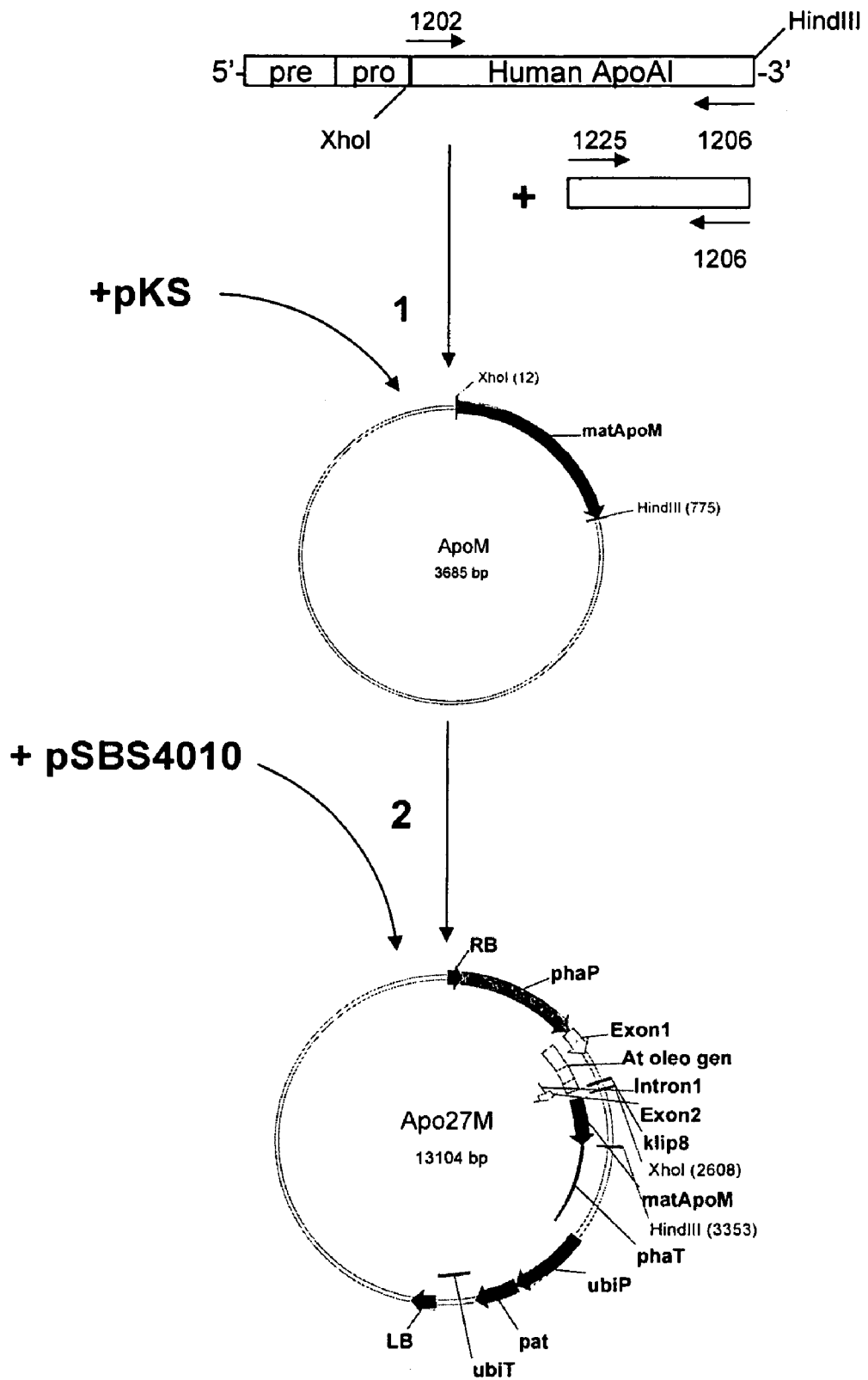
FIG. 8(B). Schematic drawing for the cloning strategy for the pro-form of the coding region of Apo AI$_{Milano}$. Apo27M for seed-specific targeting of Apo AI$_{Milano}$ to the oil bodies as an in-frame fusion with oleosin.

Apo27M (SEQ ID NO:189) is a seed-preferred clone which is constructed as per FIG. 8(B). As seen in FIG. 2, the Apo27M clone consists of a seed-preferred promoter and terminator (phaseolin) driving the expression of oleosin/klip8/met/Apo AI-M (SEQ ID NO:190). This construct has a klip8 cleavage sequence (SEQ ID NO:143) to facilitate cleavage of the fusion protein with chymosin. To construct this clone, forward primer 1202 (5'-GCAGCA CTCGAGcaagttcGATGAACCCCCCCAGAGCCC-3') (SEQ ID NO:191) adds an XhoI site and extra nucleotides to facilitate in-frame cloning into the klip8 cleavage sequence to the start of mat-Apo AI. Forward primer 1225 (5'-CGCCAGt-GCTTGGCCGCGCGCCTTG-3') (SEQ ID NO:192) is a blunt ended primer which makes a base pair mutation from C to T to change an Arg residue into a Cys residue. Reverse primer 1206 (5'-GTGGTG AAGCTTTCACTGGGTGTTGAGCTTCTTAGTGTACTC CTcAGA GCG-3') (SEQ ID NO:174) adds a HindIII site after the stop codon and adds a silent mutation to remove the second XhoI site. Both primers contained extra bases on the 5'ends to facilitate restriction enzyme digestion. The template for these primers was the plasmid P-10 which already had its XhoI sites mutated. The double-stranded template was removed by DpnI digestion. The PCR fragment was digested with XhoI and HindIII and ligated into the plasmid pKS+ XhoI/HindIII sites creating plasmid ApoM. ApoM was digested with XhoI and HindIII and the fragment was ligated into the XhoI/HindIII sites of the plasmid SBS4010 (FIG. 7). SBS4010 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a klip8 cleavage site. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo27M is a clone for seed-specific targeting of oleosin/klip8/met/Apo AI-M to the oil bodies and purification using the klip8 cleavage sequence.

Apo28

Figure 9:
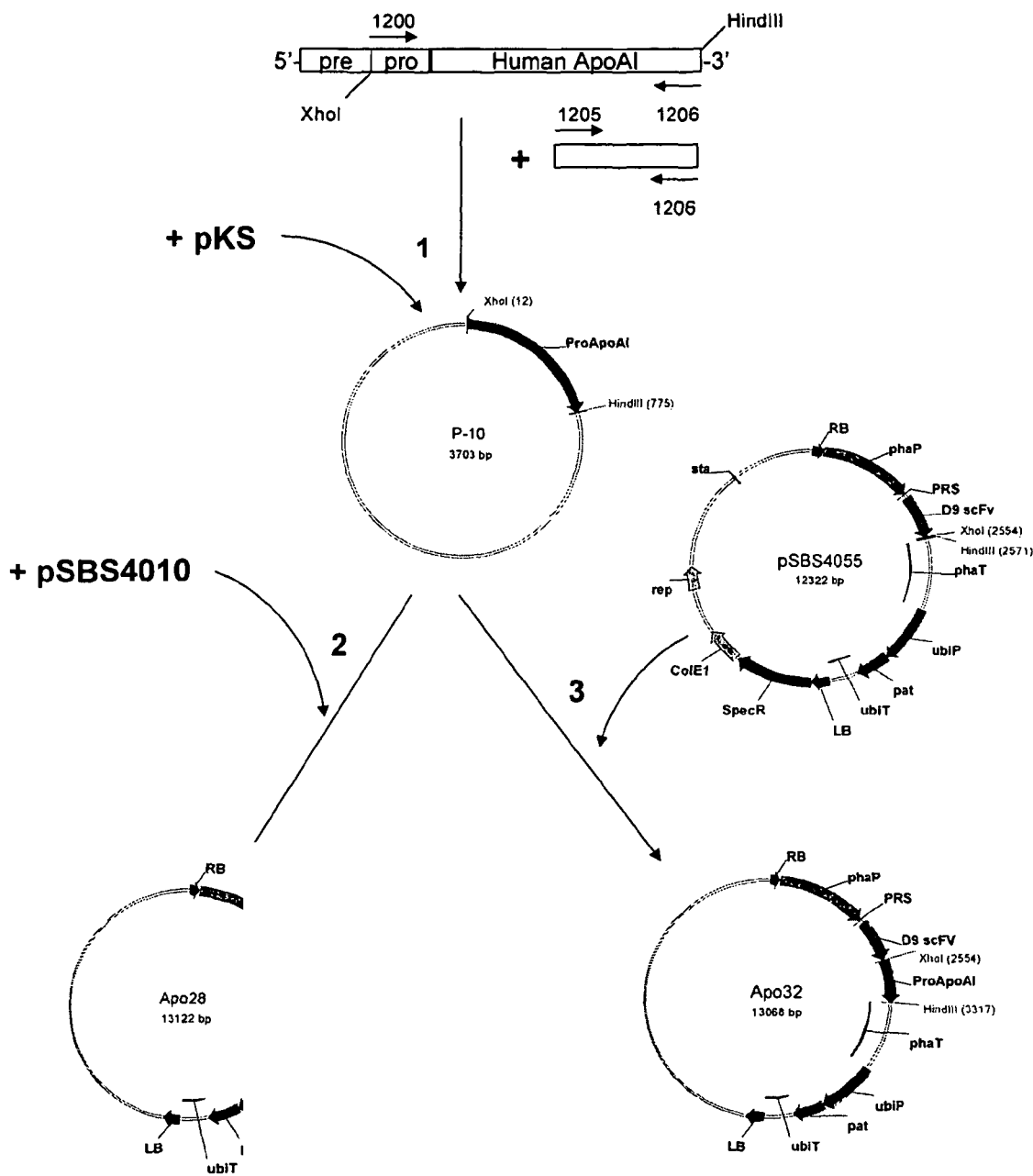
FIG. 9. Schematic drawing for the cloning strategy for the pro-form of the coding region of Apo AI with the internal XhoI sites removed. Apo28, targeted to oil bodies and able to be cleaved at the klip8 sequence, Apo32 which targets Apo AI to the secretory pathway fused in-frame to the oleosin antibody D9.

Apo28 (SEQ ID NO:193) is a seed-preferred clone which is constructed as per FIG. 9. As seen in FIG. 2, the Apo28 clone consists of a seed-preferred promoter and terminator (phaseolin) driving the expression of oleosin/klip8/pro-Apo AI (SEQ ID NO:194). To construct this clone forward primer 1200 (SEQ ID NO:188) (5'-GCAGCACTCGAGcaagttcCG-GCATTTCTGGCAGCAAGA-3') adds an XhoI site and extra nucleotides to facilitate in-frame cloning into the klip8 cleavage sequence to the start of pro-Apo AI. Forward primer 1205 (SEQ ID NO:195) (5'-CCAAGCCCGCGCTaGAG-GACCTCCG-3') is a blunt ended primer which adds a silent mutation to remove the first XhoI site. Reverse primer 1206 (SEQ ID NO: 174) (5'-GTGGTGAAGCTTTCACTGGGT-GTTGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The template for these primers was a pKS+ based vector (Stratagene) which contained the entire coding sequence for human Apo AI gene. The double-stranded template was removed by DpnI digestion. The PCR fragment was digested with XhoI and HindIII and ligated into the plasmid pKS+ XhoI/HindIII sites creating plasmid P-10. P-10 was digested with XhoI and HindIII and the fragment was ligated into the XhoI/HindIII sites of the plasmid SBS4010 (FIG. 7). Note SBS4010 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and a klip8 cleavage site. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684)) for transformation into *Agrobacterium*. Apo28 is a pro-Apo AI clone targeted to oil bodies and able to be cleaved at the klip8 sequence.

Apo29

Apo29 (SEQ ID NO:196) is a seed-preferred clone which is constructed as per FIG. 6. As seen in FIG. 2, the Apo29 clone consists of a seed-preferred promoter and terminator (phaseolin) driving the expression of PRS-Apo AI (SEQ ID NO:197). Apo29 was targeted for expression to the through the secretory pathway using the tobacco pathogen related sequence (PRS) signal peptide (Sijmons et al., 1990, Bio/technology, 8: 217-221). To construct this clone forward primer 1203 (SEQ ID NO:173) (5'-GCAGCACCATGGAT-GAACCCCCCAGAGCCCCTG-3') adds an NcoI site to the start of mature Apo AI. Reverse primer 1206 (SEQ ID NO:174) (5'-GTGGTGAAGCTTTCACTGGGTGT-TGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The PCR fragment was digested with NcoI and HindIII and ligated into the plasmid SBS2090 creating plasmid 5-3 (FIG. 6). Plasmid 5-3 was digested with NcoI and HindIII and the Apo AI fragment was ligated into the NcoI/HindIII sites of SBS4011 (FIG. 3D). SBS4011 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and the PRS signal peptide (Sijmons et al., 1990, Bio/technology, 8: 217-221). The plasmid also contains a pat gene conferring host plant phosphinothricine resistance (Wohlleben et al., 1988, Gene 70: 25-37)) driven by the ubiquitin promoter/terminator/ terminator from *Petroselinum crispum* (Kawalleck et al., 1993, Plant. Mol. Bio., 21: 673-684) for transformation into *Agrobacterium*. Apo29 is a clone for seed-specific targeting of Apo AI to the secretory pathway.

Apo30

Apo30 (SEQ ID NO:198) is a seed-preferred clone which is constructed as per FIG. 7. As seen in FIG. 2, the Apo30 clone consists of a seed-preferred promoter and terminator (phaseolin) driving the expression of PRS-pro-Apo AI (SEQ ID NO:199). Pro-Apo AI was targeted for expression to the secretory pathway using the tobacco pathogen related sequence (PRS) signal peptide (Sijmons et al., 1990, Bio/technology, 8: 217-221). To construct this clone forward primer 1201 (SEQ ID NO:177) (5'-GCAGCAC-CATGGggCGGCATTTCTGGCAGCAAGATG-3') adds an NcoI site to the start of pro-Apo AI. Reverse primer 1206 (SEQ ID NO:174) (5'-GTGGTGAAGCTTTCACTGGGT-GTTGAGCTTCTTAGTGTACTCCTCcAGA GCG-3') adds a HindIII site after the stop codon and adds a silent mutation to remove the second XhoI site. Both primers contained extra bases on the 5'ends to facilitate RE digestion. The PCR fragment was digested with NcoI and HindIII and ligated into the plasmid SBS2090 creating plasmid 4-2 (FIG. 7). Plasmid 4-2 was digested with NcoI and HindIII and the Apo AI fragment was ligated into the NcoI/HindIII sites of pSBS4011 (FIG. 3D). SBS4011 contains the β-phaseolin promoter/terminator from *Phaseolus vulgaris* (Slightom et al., 1983, Proc. Natl. Acad. Sc. USA 80: 1897-1901) controlling the expression of the *Arabidopsis* oleosin gene (van Rooijen G. J. et al. 1992, Plant Mol. Biol. 18 (6), 1177-1179) and the PRS signal peptide (Sijmons et al., 1990, Bio/technology, 8: 217-221). The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684)) for transformation into *Agrobacterium*. Apo30 is a clone for seed-specific targeting of pro-Apo AI to the secretory pathway.

Apo31

Apo31 (SEQ ID NO:200) is a seed-preferred clone which is constructed as per FIG. 8(A). As seen in FIG. 2, the Apo28 clone consists of a seed-preferred promoter and terminator (phaseolin) driving the expression of PRS/D9 scFV/Apo AI (SEQ ID NO:201) fusion protein. D9 ScFV/Apo AI was targeted for expression to the secretory pathway using the tobacco pathogen related sequence (PRS) signal peptide (Sijmons et al., 1990, Bio/technology, 8: 217-221). To construct this clone forward primer 1200 (SEQ ID NO:188) (5'-GCAG-CACTCGAGcaagttcCGGCATTTCTGGCAGCAAGA-3') adds an XhoI site to the start of pro-Apo AI. Reverse primer 1206 (SEQ ID NO: 174) (5'-GTGGT-GAAGCTTTCACTGGGTGTTGAGCTTCT-
TAGTGTACTCCTCcAGA GCG-3') adds a HindIII site after the stop codon and adds a silent mutation to remove the second XhoI site. The template for these primers was the Apo33 plasmid which contains the pro-form of Apo AI without internal XhoI sites and additional Met residue. The PCR fragments were cut with XhoI and ligated into the XhoI/EcoRV sites of pKS+ creating the plasmid 6-3. Plasmid 6-3 was cut with XhoI and HindIII and ligated into the XhoI/HindIII sites of binary bector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe to the D9 scFV/Apo AI insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant.

Mol. Bio., 21: 673-684) for transformation into *Agrobacterium*. Apo31 is a clone for for seed-specific targeting of Apo AI to the secretory pathway and purification with the oleosin D9 scFV antibody.

Apo32

Apo32 (SEQ ID NO:202) is a seed-preferred clone which is constructed as per FIG. 9. As seen in FIG. 2, the Apo32 clone consists of a seed-preferred promoter and terminator (phaseolin) driving the expression of D9 scFV/pro-Apo AI (SEQ ID NO:203). To construct this clone forward primer 1200 (SEQ ID NO:188) (5'-GCAGCACTCGAGcaagttcCGGCATTTCTGGCAGCAAGA-3') adds an XhoI site to the start of pro-Apo AI. Forward primer 1205 (SEQ ID NO:195) (5'-CCAAGCCCGCGCTaGAGGACCTCCG-3') is a blunt ended primer which adds a silent mutation to remove the first XhoI site. Reverse primer 1206 (SEQ ID NO: 174) (5'-GTGGTGAAGCTTTCACTGGGTGTTGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The template for these primers was a pKS+ based vector (Stratagene) which contained the entire coding sequence for human Apo AI gene. The double-stranded template was removed by DpnI digestion. The PCR fragment was digested with XhoI and HindIII and ligated into the plasmid pKS+ XhoI/HindIII sites creating plasmid P-10. P-10 was digested with XhoI and HindIII and the fragment was ligated into the XhoI/HindIII sites of the plasmid SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe to the D9 scFV antibody. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. Apo32 is a clone targeting pro-Apo AI to the sectretory pathway fused in-frame to the oleosin antibody D9 to aid in purification.

Apo33

Figure 10:
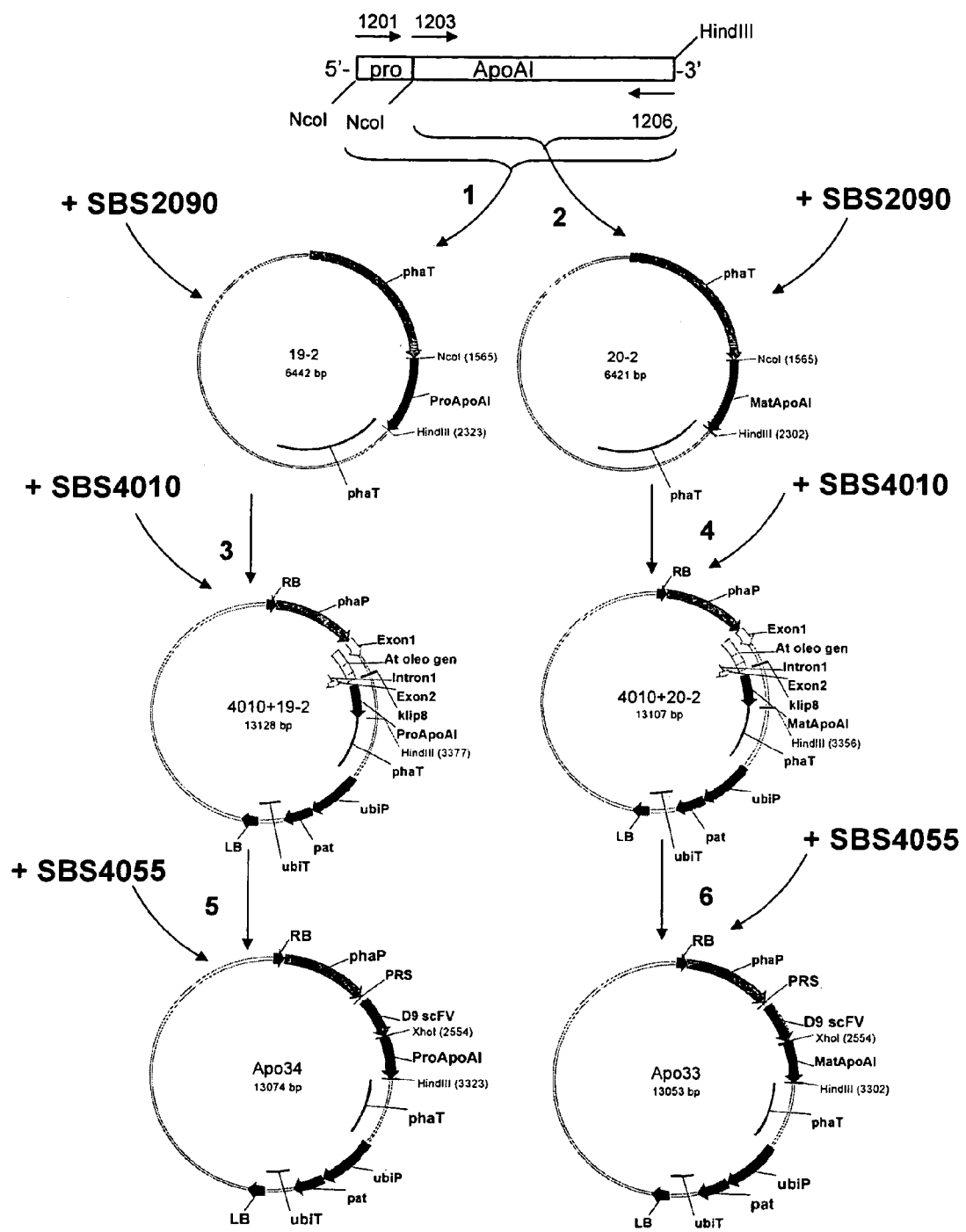
FIG. 10. Schematic drawing for the cloning strategy for the pro- and mature forms of the coding region of Apo AI with the internal XhoI sites removed containing an additional Met residue at start of coding region. Apo34 (pro-Apo AI) and Apo33 (mature Apo AI) which are targeted to the secretory pathway and are fused in-frame with the oleosin antibody D9.

Apo33 (SEQ ID NO:204) is a seed-preferred clone which is constructed as per FIG. 10. As seen in FIG. 2, the Apo33 clone consists of a seed-preferred promoter and terminator (phaseolin) driving the expression of PRS/D9 scFV/met/Apo AI/(SEQ ID NO:205) fusion protein. D9 ScFV/met/Apo AI was targeted for expression to the secretory pathway using the tobacco pathogen related sequence (PRS) signal peptide (Sijmons et al., 1990, Bio/technology, 8: 217-221). To construct this clone forward primer 1203 (SEQ ID NO:173) (5'-GCAGCA CCATGGATGAACCCCCCCAGAGCCCCTG-3') adds an NcoI site to the start of mature Apo AI. Reverse primer 1206 (SEQ ID NO:174) (5'-GTGGTGAAGCTTTCACTGGGTGTTGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The template for these primers was the P-10 plasmid (FIG. 9) which contains the pro-form of Apo AI without internal XhoI sites. The PCR fragment was digested with NcoI and HindIII and ligated into the NcoI/HindIII sites of pSBS2090 creating plasmid 20-2. The plasmid was cut with NcoI and HindIII and the fragment ligated into the pSBS4010 vector BspHI/HindIII sites creating plasmid 4010+20-2. The plasmid was cut with XhoI and HindIII and the fragment was ligated into the XhoI/HindIII sites of the binary vector SBS4055 (FIG. 10). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe to the D9 scFV antibody. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo33 is a seed-specific clone which targets Apo AI to the secretory pathway and fused in-frame with the oleosin antibody D9 to aid in purification.

Apo34

Apo34 (SEQ ID NO:206) is a seed-preferred clone which is constructed as per FIG. 10. As seen in FIG. 2, the Apo34 clone consists of a seed-preferred promoter and terminator (phaseolin) driving the expression of PRS/D9 scFV/met/pro-Apo AI/(SEQ ID NO:207) fusion protein. D9 ScFV/met/pro-Apo AI was targeted for expression to the secretory pathway using the tobacco pathogen related sequence (PRS) signal peptide (Sijmons et al., 1990, Bio/technology, 8: 217-221). To construct this clone forward primer 1201 (SEQ ID NO:177) (5'-GCAGCA CCATGGggCGGCATTTCTGGCAGCAAGATG-3') adds an NcoI site to the start of pro-Apo AI. Reverse primer 1206 (SEQ ID NO:174) (5'-GTGGTGAAGCTTTCACTGGGTGTTGAGCTTCTTAGTGTACTCCTCcAGA GCG-3') adds a HindIII site after the stop codon and adds a silent mutation to remove the second XhoI site. Both primers contained extra bases on the 5'ends to facilitate restriction enzyme digestion. The template for these primers was the P-10 plasmid (FIG. 9) which contains the pro-form of Apo AI without internal XhoI sites. The PCR fragment was digested with NcoI and HindIII and ligated into the NcoI/HindIII sites of SBS2090 (FIG. 3(B)) creating plasmid 19-2. The plasmid was cut with NcoI and HindIII and the fragment ligated into the SBS4010 vector BspHI/HindIII sites creating plasmid 4010+19-2. The plasmid was cut with XhoI and HindIII and the fragment was ligated into the XhoI/HindIII sites of the binary vector SBS4055 (FIG. 10). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe to the D9 scFV antibody. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. Apo34 is a seed-specific clone which targets met/pro-Apo AI to the secretory pathway and fused in-frame with the oleosin antibody D9 to aid in purification.

Apo35

Apo35 (SEQ ID NO:208) is a seed-preferred clone which is constructed as per FIG. 8. As seen in FIG. 2, the Apo35 clone consists of a seed-preferred promoter and terminator (phaseolin) driving the expression of PRS/D9 scFV/Apo AI/KDEL (SEQ ID NO:209) fusion protein. D9 ScFV/Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. To construct this clone forward primer 1200 (SEQ ID NO:188) (5'-GCAGCACTCGAGcaagttcCGGCATTTCTGGCAGCAAGA-3') adds an XhoI site to the start of pro-Apo AI. Reverse primer 1208 (SEQ ID NO:210) (5'-AAGCTTTCAtagctcatctttCTGGGTGTTGAGCTTCTTAG-3)' adds a KDEL sequence before the stop codon and a HindIII site after the stop codon. The template for these primers was the Apo33 plasmid which contains the pro-form of Apo AI without internal XhoI sites and additional Met residue. The PCR fragments were cut with XhoI and ligated into the XhoI/EcoRV sites of pKS+ creating the plasmid 8-5. Plasmid 8-5 was cut with XhoI and HindIII and ligated into the XhoI/HindIII sites of binary bector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo35 is a clone for for seed-specific targeting of Apo AI to the secretory pathway with retention in the ER and purification with the oleosin D9 scFV antibody.

Apo36

Figure 11:
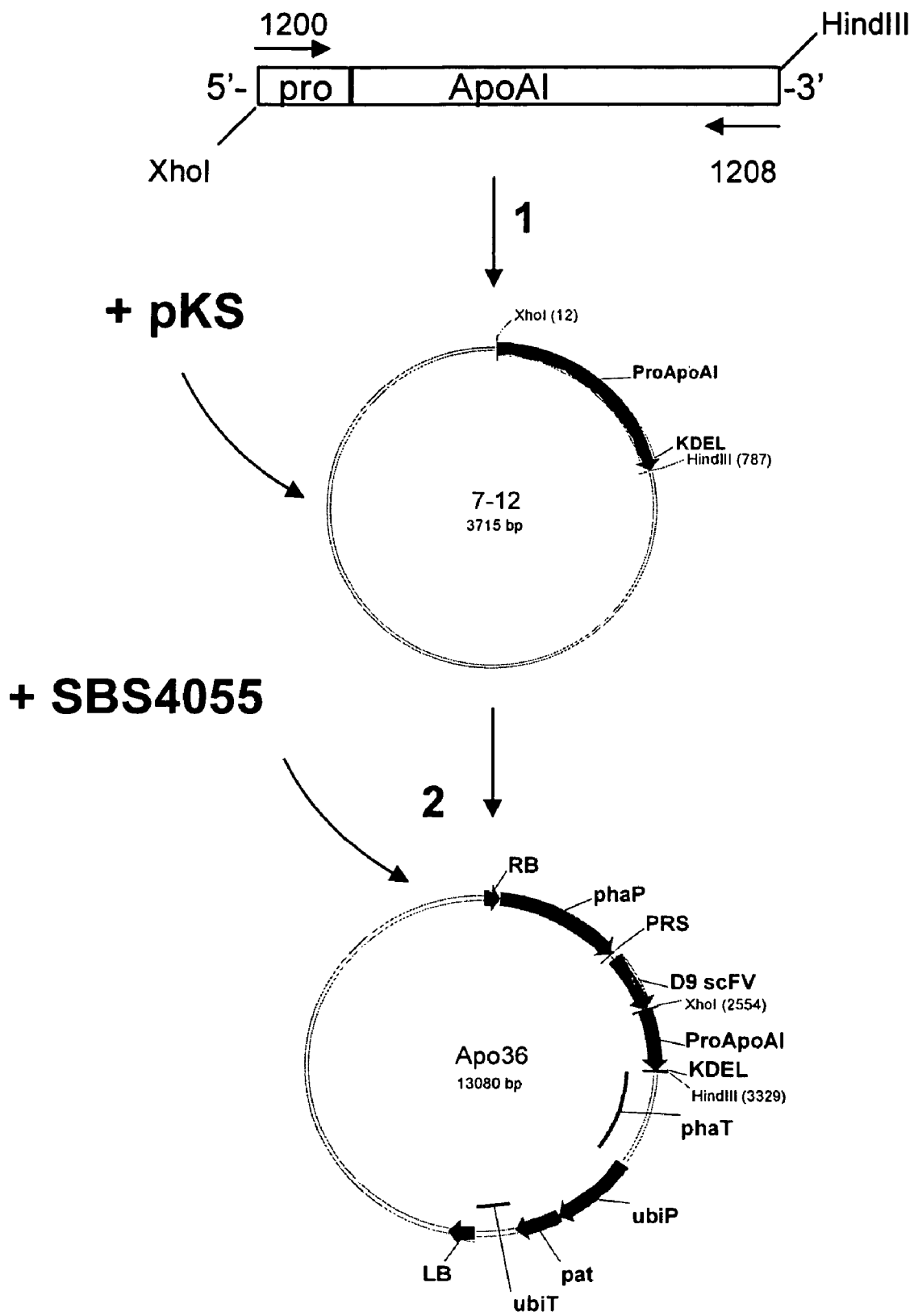
FIG. 11. Schematic drawing for the cloning strategy for the pro-form of the coding region of Apo AI with the internal XhoI sites containing a KDEL signal peptide. Apo36, targeted to the secretory pathway and is fused in-frame with the oleosin antibody D9, and accumulates in the endoplasmic reticulum due to a KDEL signal peptide.

Apo36 (SEQ ID NO:211) is a seed-preferred clone which is constructed as per FIG. 11. As seen in FIG. 2, the Apo36 clone consists of a seed-preferred promoter and terminator (phaseolin) driving the expression of PRS/D9 scFV/pro-Apo AI/KDEL (SEQ ID NO:212) fusion protein. D9 ScFV/pro-Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. To construct this clone forward primer 1200 (SEQ ID NO:188) (5'-GCAGCA CTCGAGcaagttcCGGCATTTCTGGCAGCAAGA-3') adds an XhoI site and extra nucleotides to facilitate in-frame cloning into the klip8 cleavage sequence to the start of pro-Apo AI. Reverse primer 1208 (SEQ ID NO:210) (5'-AAGCTTTCAtagctcatctttCTGGGTGTTGAGCTTCTTA G-3') adds a KDEL sequence before the stop codon and a HindIII site after the stop codon. The template for these primers was the P-10 (FIG. 9) plasmid which contains the pro-form of Apo AI without internal XhoI sites. The PCR fragment was cut with XhoI and HindIII and ligated into the XhoI/HindIII sites of pKS+ creating the plasmid 7-12. Plasmid 7-12 was cut with XhoI and HindIII and ligated into the XhoI/HindIII sites of the binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo36 is a clone for the seed-specific expression of pro-Apo AI targeted to the secretory pathway and is fused in-frame with the oleosin antibody D9, and accumulates in the endoplasmic reticulum due to a KDEL signal peptide.

Apo37

Figure 12:
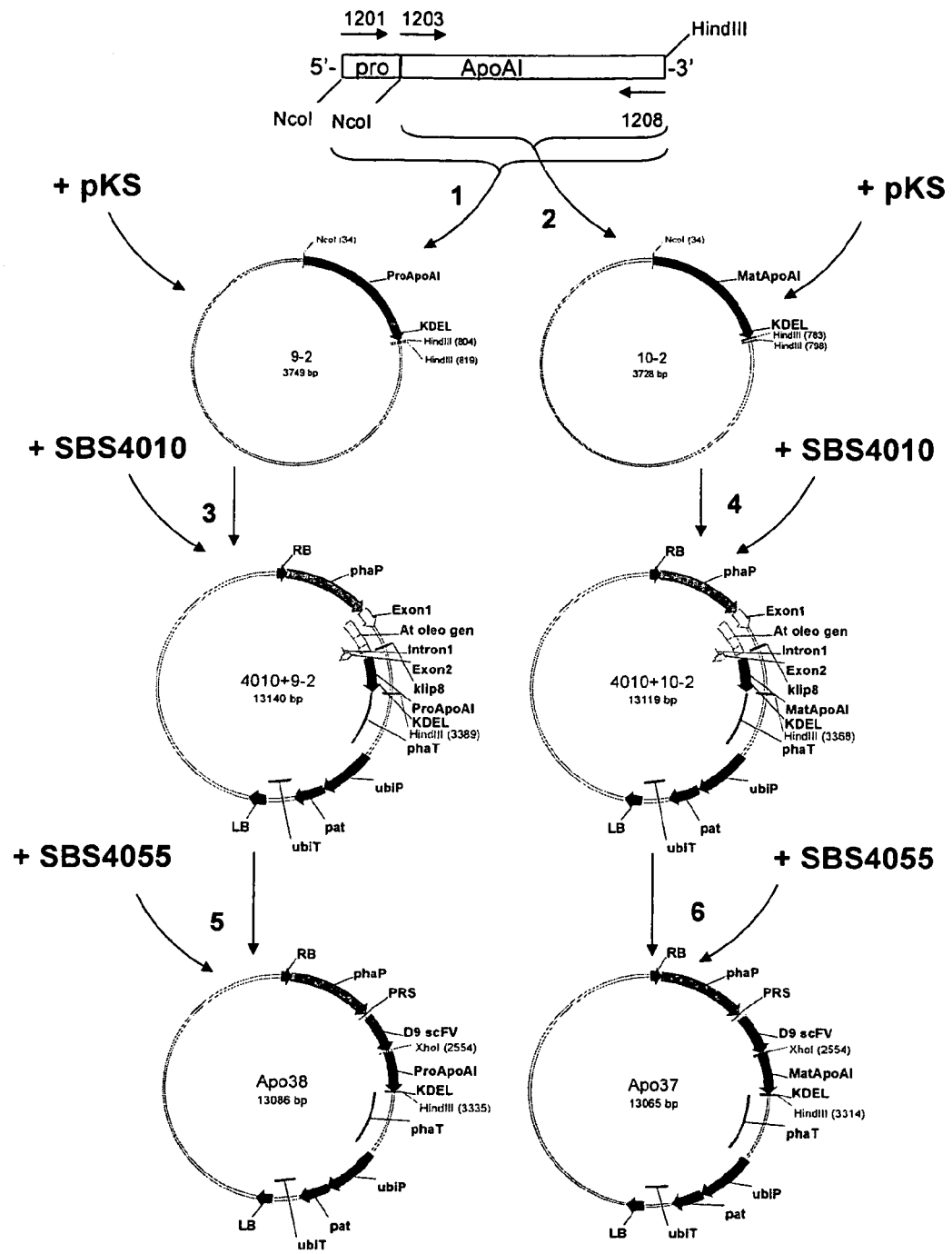
FIG. 12. Schematic drawing for the cloning strategy for the pro- and mature forms of the coding region of Apo AI with the internal XhoI sites removed containing an additional Met residue at start of coding region and a KDEL signal peptide. Apo38 and Apo37 which are targeted to the secretory pathway and are fused in-frame with the oleosin antibody D9, and accumulate in the endoplasmic reticulum due to a KDEL signal peptide.

Apo37 (SEQ ID NO:213) is a seed-preferred clone which is constructed as per FIG. 12. As seen in FIG. 2, the Apo37 clone consists of a seed-preferred promoter and terminator (phaseolin) driving the expression of PRS/D9 scFV/met/Apo AI/KDEL (SEQ ID NO:214) fusion protein. D9 ScFV/met/Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. To construct this clone forward primer 1203 (SEQ ID NO:173) (5'-GCAGCA CCATGGATGAACCCCCCCAGAGCCCCTG-3') adds an NcoI site to the start of mature Apo AI. Reverse primer 1208 (SEQ ID NO:210) (5'-AAGCTTTCAtagctcatctttCTGGGTGTTGAGCTTCTTA G-3') adds a KDEL sequence before the stop codon and a HindIII site after the stop codon. The template for these primers was the P-10 plasmid (FIG. 9) which contains the pro-form of Apo AI without internal XhoI sites. The PCR fragment was ligated into the EcoRV sites of pKS+plasmid creating plasmid 10-2. The plasmid was cut with NcoI and HindIII and the fragment was ligated into the SBS4010 vector BspHI/HindIII sites creating plasmid 4010+10-2. The plasmid was cut with XhoI and HindIII and the fragment was ligated into the XhoI/HindIII sites of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo37 is a clone which targets met/Apo AI to the secretory pathway and is fused in-frame with the oleosin antibody D9, and accumulate in the endoplasmic reticulum due to a KDEL signal peptide.

Apo38

Apo38 (SEQ ID NO:215) is a seed-preferred clone which is constructed as per FIG. 12. As seen in FIG. 2, the Apo38 clone consists of a seed-preferred promoter and terminator (phaseolin) driving the expression of PRS/D9 scFV/met/pro-Apo AI/KDEL (SEQ ID NO:216) fusion protein. D9 ScFV/met/pro-Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. To construct this clone forward primer 1201 (SEQ ID NO:177) (5'-GCAGCA CCATGGggCGGCATTTCTGGCAGCAAGATG-3') adds an NcoI site to the start of mature Apo AI. Reverse primer 1208 (SEQ ID NO:210) (5'-AAGCTTTCAtagctcatctttCTGGGTGTTGAGCTTCTTA G-3') adds a KDEL sequence before the stop codon and a HindIII site after the stop codon. The template for these primers was the P-10 plasmid (FIG. 9) which contains the pro-form of Apo AI without internal XhoI sites. The PCR fragment was ligated into the EcoRV sites of pKS+ plasmid creating plasmid 9-2. The plasmid was cut with NcoI and HindIII and the fragment was ligated into the SBS4010 vector BspHI/HindIII sites creating plasmid 4010+9-2. The plasmid was cut with XhoI and HindIII and the fragment was ligated into the XhoI/HindIII sites of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from Petroselinum crispum (Kawalleck et al., 1993, Plant. Mol. Bio., 21: 673-684) for transformation into *Agrobacterium*. Apo38 is a clone which targets met/pro-Apo AI to the secretory pathway and is fused in-frame with the oleosin antibody D9, and accumulate in the endoplasmic reticulum due to a KDEL signal peptide.

Apo39

Figure 13:
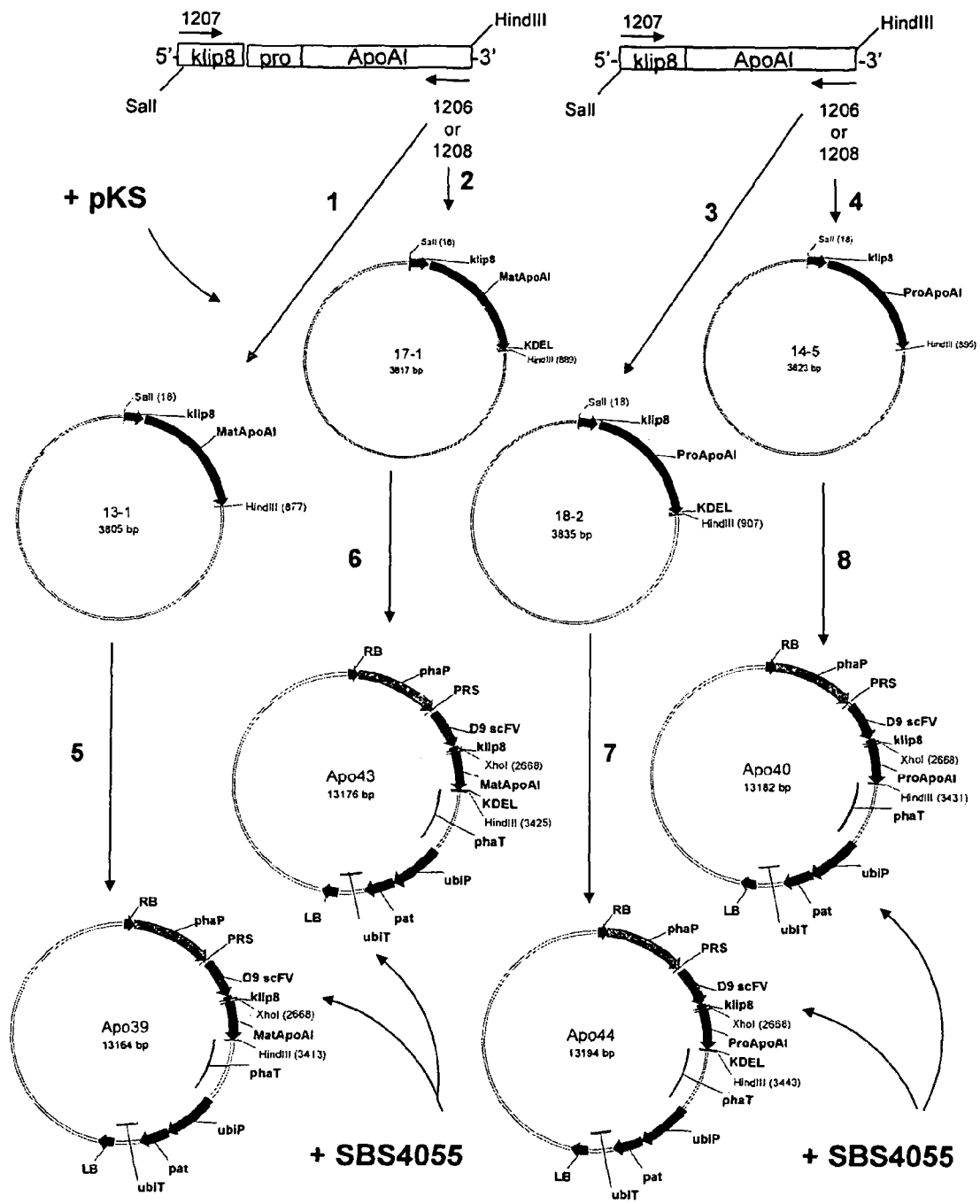
FIG. 13. Schematic drawing for the cloning strategy for the pro- and mature forms of the coding region of Apo AI and a protease cleavage site. Apo43, Apo44, Apo39 and Apo40 targeted to the secretory pathway, fused in-frame with the oleosin antibody D9. Apo43 and Apo44 would accumulate in the endoplasmic reticulum due to a KDEL signal peptide.

Apo39 (SEQ ID NO:217) is a seed-preferred clone which is constructed as per FIG. 13. As seen in FIG. 2, the Apo39 clone consists of a seed-preferred promoter and terminator (phaseolin) driving the expression of PRS/D9 scFV/klip8/Apo AI (SEQ ID NO:218) fusion protein. D9 ScFV/klip8/Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. This clone has a klip8 cleavage sequence (SEQ ID NO:143) to facilitate cleavage of the fusion protein with chymosin. To construct this clone forward primer 1207 (SEQ ID NO:219) 5'-GCAGCA GTCGACtATGGCTGAGATCACCCGCATTC-3') sequence and adds a SalI site to the start codon. Reverse primer 1206 (SEQ ID NO:174) (5'-GTGGTG AAGCTTTCACTGGGTGTTGAGCTTCTTAGTGTACTC CTCcAGA GCG-3') adds a HindIII site after the stop codon and adds a silent (amplifies the start of the klip8) mutation to remove the second XhoI site. The template for the PCR reaction was the plasmid Apo27 (FIG. 8(A)). The PCR product was cut with SalI and HindIII and ligated into pKS+ creating the plasmid 13-1. The plasmid was cut with SalI and HindIII and ligated into the XhoI/HindIII sites of plasmid SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684)) for transformation into *Agrobacterium*. Apo39 is a clone for the seed-preferred expression of D9 scFV/klip8/Apo AI targeted to the secretory pathway. Purification of Apo AI is achieved using the D9 scFV antibody which has affinity for the oleosin on the oil body. The protein can be cleaved using chymosin which will cleave the klip8 site.

Apo40

Apo40 (SEQ ID NO:220) is a seed-preferred clone which is constructed as per FIG. 13. As seen in FIG. 2, the Apo40 clone consists of a seed-preferred promoter and terminator (phaseolin) driving the expression of PRS/D9 scFV/klip8/pro-Apo AI (SEQ ID NO:221) fusion protein. D9 ScFV/klip8/pro-Apo AI was targeted for expression to the secretory pathway using the tobacco pathogen related sequence (PRS) signal peptide (Sijmons et al., 1990, Bio/technology, 8: 217-221). This clone has a klip8 cleavage sequence (SEQ ID NO:143) to facilitate cleavage of the fusion protein with chymosin. To construct this clone forward primer 1207 (SEQ ID NO:219) 5'-GCAGCA GTCGACtATGGCTGAGATCACCCGCATTC-3') sequence and adds a SalI site to the start codon. Reverse primer 1206 (SEQ ID NO:174) (5'-GTGGTG AAGCTTTCACTGGGTGTTGAGCTTCTTAGTGTACTC CTCcAGA GCG-3') adds a HindIII site after the stop codon and adds a silent mutation to remove the second XhoI site. The template for the PCR reaction was the plasmid Apo27 (FIG. 8(A)). The PCR product was cut with SalI and HindIII and ligated into pKS+ creating the plasmid 14-5. The plasmid was cut with SalI and HindIII and ligated into the XhoI/HindIII sites of plasmid SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo40 is a clone for the seed-preferred expression of D9 scFV/klip8/pro-Apo AI targeted to the secretory pathway. Purification of pro-Apo AI is achieved using the D9 scFV antibody which has affinity for the oleosin on the oil body. The protein can be cleaved using chymosin which will cleave the klip8 site.

Apo 41

Figure 14:
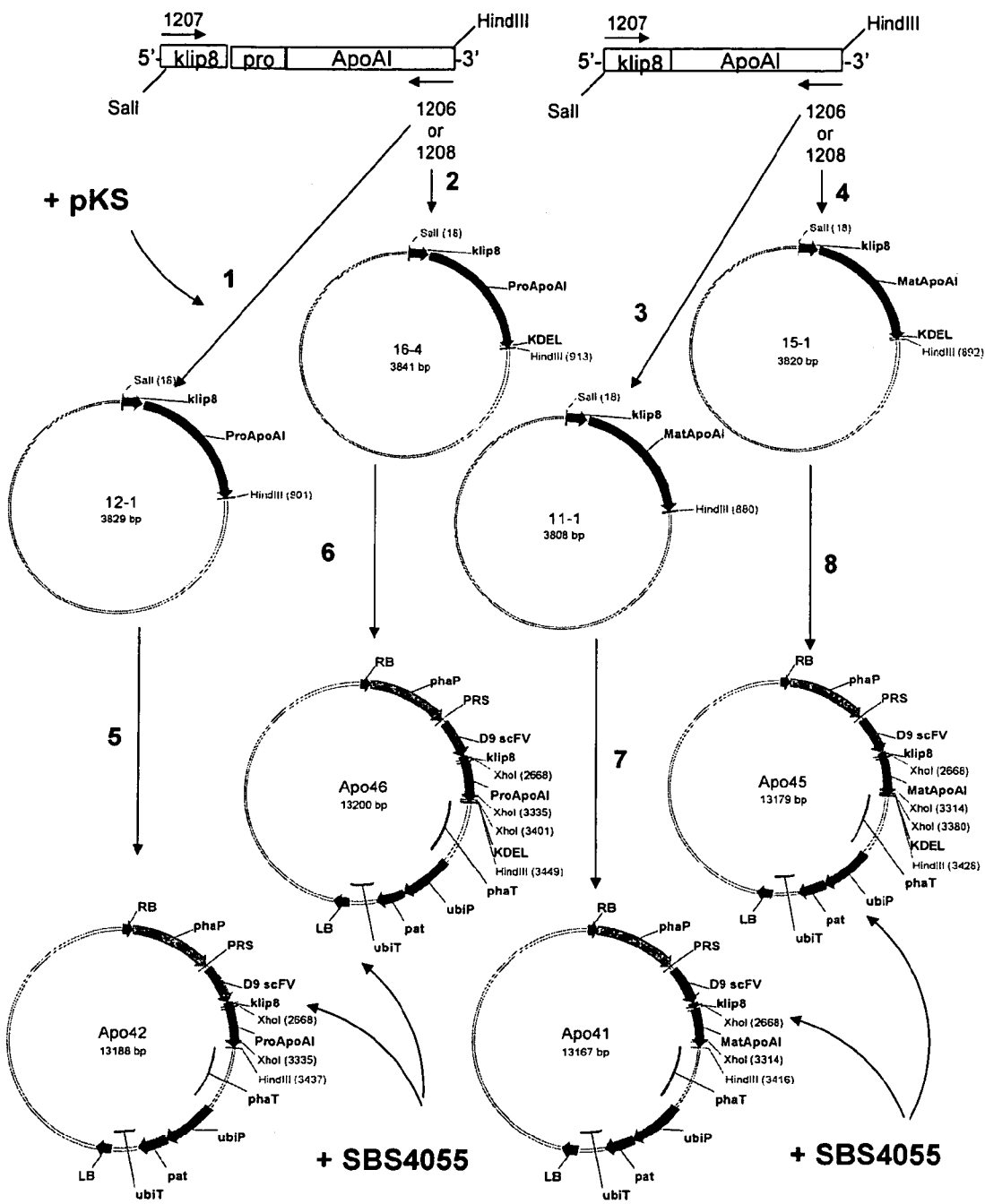
FIG. 14. Schematic drawing for the cloning strategy for the pro- and mature forms of the coding region of Apo AI, containing an additional Met residue at start of coding region and a protease cleavage site. Apo42, Apo46, Apo41, and Apo45 targeted to the secretory pathway, fused in-frame with the oleosin antibody D9. Apo46 and Apo45 would accumulate in the endoplasmic reticulum due to a KDEL signal peptide.

Apo41 (SEQ ID NO:222) is a seed-preferred clone which is constructed as per FIG. 14. As seen in FIG. 2, the Apo41 clone consists of a seed-preferred promoter and terminator (phaseolin) driving the expression of PRS/D9 scFV/klip8/met/Apo AI (SEQ ID NO:223) fusion protein. D9 ScFV/klip8/met/Apo AI was targeted for expression to the secretory pathway using the tobacco pathogen related sequence (PRS) signal peptide (Sijmons et al., 1990, Bio/technology, 8: 217-221). This clone has a klip8 cleavage sequence (SEQ ID NO:143) to facilitate cleavage of the fusion protein with chymosin. To construct this clone forward primer 1207 (SEQ ID NO:219) (5'-GCAGCA GTCGACtATGGCTGAGATCACCCGCATTC-3') amplifies the start of the klip8 sequence and adds a SalI site to the start codon. Reverse primer 1206 (SEQ ID NO:174) (5'-GTGGTG AAGCTTTCACTGGGTGTTGAGCTTCTTAGTGTACTC CTCcAGA GCG-3') adds a HindIII site after the stop codon and adds a silent mutation to remove the second XhoI site. The template for the PCR reaction was the plasmid Apo25 (FIG. 6). The PCR product was cut with SalI and HindIII and ligated into pKS+ creating the plasmid 11-1. The plasmid was cut with SalI and HindIII and ligated into the XhoI/HindIII site of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684)) for transformation into *Agrobacterium*. Apo41 is a clone for the seed-preferred expression of D9 scFV/klip8/met/Apo AI targeted to the secretory pathway. Purification of met/Apo AI is achieved using the D9 scFV antibody which has affinity for the oleosin on the oil body. The protein can be cleaved using chymosin which will cleave the klip8 site.

Apo42

Apo42 (SEQ ID NO:224) is a seed-preferred clone which is constructed as per FIG. 14. As seen in FIG. 2, the Apo42 clone consists of a seed-preferred promoter and terminator (phaseolin) driving the expression of PRS/D9 scFV/klip8/met/pro-Apo AI (SEQ ID NO:225) fusion protein. D9 ScFV/klip8/met/pro-Apo AI was targeted for expression to the secretory pathway using the tobacco pathogen related sequence (PRS) signal peptide (Sijmons et al., 1990, Bio/technology, 8: 217-221). This clone has a klip8 cleavage sequence (SEQ ID NO:143) to facilitate cleavage of the fusion protein with chymosin. To construct this clone forward primer 1207 (SEQ ID NO:210) (5'-GCAGCA GTCGACtATGGCTGAGATCACCCGCATTC-3') amplifies the start of the klip8 sequence and adds a SalI site to the start codon. Reverse primer 1206 (SEQ ID NO:174) (5'-GTGGTG AAGCTTTCACTGGGTGTTGAGCTTCTTAGTGTACTC CTCcAGA GCG-3') adds a HindIII site after the stop codon and adds a silent mutation to remove the second XhoI site. The template for the PCR reaction was the plasmid Apo26 (FIG. 7). The PCR product was cut with SalI and HindIII and ligated into pKS+ creating the plasmid 12-1. The plasmid was cut with SalI and HindIII and ligated into the XhoI/HindIII site of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37)) driven by the ubiquitin promoter/terminator from *Petroselinum crispum* (Kawalleck et al., 1993, Plant. Mol. Bio., 21: 673-684) for transformation into *Agrobacterium*. Apo42 is a clone for the seed-preferred expression of D9 scFV/klip8/met/pro-Apo AI targeted to the secretory pathway. Purification of met/Apo AI is achieved using the D9 scFV antibody which has affinity for the oleosin on the oil body. The protein can be cleaved using chymosin which will cleave the klip8 site.

Apo43

Apo43 (SEQ ID NO:226) is a seed-preferred clone which is constructed as per FIG. 13. As seen in FIG. 2, the Apo43 clone consists of a seed-preferred promoter and terminator (phaseolin) driving the expression of PRS/D9 scFV/klip8/Apo AI/KDEL (SEQ ID NO:227) fusion protein. D9 ScFV/klip8/Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. This clone has a klip8 cleavage sequence (SEQ ID NO:143) to facilitate cleavage of the fusion protein with chymosin. To construct this clone forward primer 1207 (SEQ ID NO:219) 5'-GCAGCA GTCGACtATGGCTGAGATCACCCGCATTC-3') sequence and adds a SalI site to the start codon. Reverse primer 1208 (SEQ ID NO:210) (5'-AAGCTTTCAtagctcatctttCTGGGTGTTGAGCTTCTTAG-3') adds a KDEL sequence before the stop codon and a HindIII site after the stop codon. The template for the PCR reaction was the plasmid Apo27 (FIG. 8(A)). The PCR product was cut with SalI and HindIII and ligated into pKS+ creating the plasmid 17-1. The plasmid was cut with SalI and HindIII and ligated into the XhoI/HindIII sites of plasmid SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo43 is a clone for the seed-preferred expression of D9 scFV/klip8/Apo AI/KDEL targeted to the secretory pathway. Apo43 will accumulate in the ER due to the KDEL signal peptide. Purification of Apo AI is achieved using the D9 scFV antibody which has affinity for the oleosin on the oil body. The protein can be cleaved using chymosin which will cleave the klip8 site.

Apo44

Apo44 (SEQ ID NO:228) is a seed-preferred clone which is constructed as per FIG. 13. As seen in FIG. 2, the Apo44 clone consists of a seed-preferred promoter and terminator (phaseolin) driving the expression of PRS/D9 scFV/klip8/pro-Apo AI/KDEL (SEQ ID NO:229) fusion protein. D9 ScFV/klip8/pro-Apo AI/KDEL was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. This clone has a klip8 cleavage sequence (SEQ ID NO:143) to facilitate cleavage of the fusion protein with chymosin. To construct this clone forward primer 1207 (SEQ ID NO:219) 5'-GCAGCA GTCGACtATGGCTGAGATCACCCGCATTC-3') sequence and adds a SalI site to the start codon. Reverse primer 1208 (SEQ ID NO:210) (5'-AAGCTTTCAtagctcatctttCTGGGTGTTGAGCTTCTTA G-3') adds a KDEL sequence before the stop codon and a HindIII site after the stop codon. The template for the PCR reaction was the plasmid Apo28 (FIG. 9). The PCR product was cut with SalI and HindIII and ligated into pKS+ creating the plasmid 18-2. The plasmid was cut with SalI and HindIII and ligated into the XhoI/HindIII sites of plasmid SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo44 is a clone for the seed-preferred expression of D9 scFV/klip8/pro-Apo AI/KDEL targeted to the secretory pathway. Apo44 will accumulate in the ER due to the KDEL signal peptide. Purification of pro-Apo AI is achieved using the D9 scFV antibody which has affinity for the oleosin on the oil body. The protein can be cleaved using chymosin which will cleave the klip8 site.

Apo45

Apo45 (SEQ ID NO:230) is a seed-preferred clone which is constructed as per FIG. 14. As seen in FIG. 2, the Apo45 clone consists of a seed-preferred promoter and terminator (phaseolin) driving the expression of PRS/D9 scFV/klip8/met/Apo AI/KDEL (SEQ ID NO:231) fusion protein. D9 ScFV/klip8/met/Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. This clone has a klip8 cleavage sequence (SEQ ID NO:143) to facilitate cleavage of the fusion protein with chymosin. To construct this clone forward primer 1207 (SEQ ID NO:219) (5'-GCAGCA GTCGACtATGGCTGAGATCACCCGCATTC-3') amplifies the start of the klip8 sequence and adds a SalI site to the start codon. Reverse primer 1208 (SEQ ID NO:210) (5'-AAGCTTTCAtagctcatctttCTGGGTGTTGAGCTTCTTA G-3') adds a KDEL sequence before the stop codon and a HindIII site after the stop codon. The template for the PCR reaction was the plasmid Apo25 (FIG. 6). The PCR product was cut with SalI and HindIII and ligated into pKS+ creating the plasmid 15-1. This plasmid was cut with SalI and HindIII and ligated into the XhoI/HindIII site of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo45 is a clone for the seed-preferred expression of D9 scFV/klip8/met/Apo AI/KDEL targeted to the secretory pathway. Apo45 will accumulate in the ER due to the KDEL signal peptide. Purification of Apo AI is achieved using the D9 scFV antibody which has affinity for the oleosin on the oil body. The protein can be cleaved using chymosin which will cleave the klip8 site.

Apo46

Apo46 (SEQ ID NO:232) is a seed-preferred clone which is constructed as per FIG. 14. As seen in FIG. 2, the Apo46 clone consists of a seed-preferred promoter and terminator (phaseolin) driving the expression of PRS/D9 scFV/klip8/met/pro-Apo AI/KDEL (SEQ ID NO:233) fusion protein. D9 ScFV/klip8/met/pro-Apo AI was targeted for expression to the secretory pathway using the tobacco pathogen related sequence (PRS) signal peptide (Sijmons et al., 1990, Bio/technology, 8: 217-221) and KDEL retention signal (Munro and Pelham, 1987, Cell 48: 899-907) is used to retain the polypeptide in the ER. This clone has a klip8 cleavage sequence (SEQ ID NO:143) to facilitate cleavage of the fusion protein with chymosin. To construct this clone forward primer 1207 (SEQ ID NO:219) (5'-GCAGCAGTCGACtATGGCTGAGATCACCCGCATTC-3') amplifies the start of the klip8 sequence and adds a SalI site to the start codon. Reverse primer 1208 (SEQ ID NO:210) (5'-AAGCTTTCAtagctcatctttCTGGGTGTTGAGCTTCTTAG-3') adds a KDEL sequence before the stop codon and a HindIII site after the stop codon. The template for the PCR reaction was the plasmid Apo26 (FIG. 7). The PCR product was cut with SalI and HindIII and ligated into pKS+creating the plasmid 16-4. The plasmid was cut with SalI and HindIII and ligated into the XhoI/HindIII site of binary vector SBS4055 (FIG. 9). Note SBS4055 contains the β-phaseolin promoter/terminator from *Phaseolus vulgaris* (Slightom et al., 1983, Proc. Natl. Acad. Sc. USA 80: 1897-1901) controlling the expression of the PRS signal sequence fused inframe a D9 scFV insert. The plasmid also contains a pat gene conferring host plant phosphinothricine resistance (Wohlleben et al., 1988, Gene 70: 25-37) driven by the ubiquitin promoter/terminator from *Petroselinum crispum* (Kawalleck et al., 1993, Plant. Mol. Bio., 21: 673-684) for transformation into *Agrobacterium*. Apo46 is a clone for the seed-preferred expression of D9 scFV/klip8/met/pro-Apo AI targeted to the secretory pathway and retained in the ER. Purification of Apo AI is achieved using the D9 scFV antibody which has affinity for the oleosin on the oil body. The protein can be cleaved using chymosin which will cleave the klip8 site.

Apo47

Figure 15:
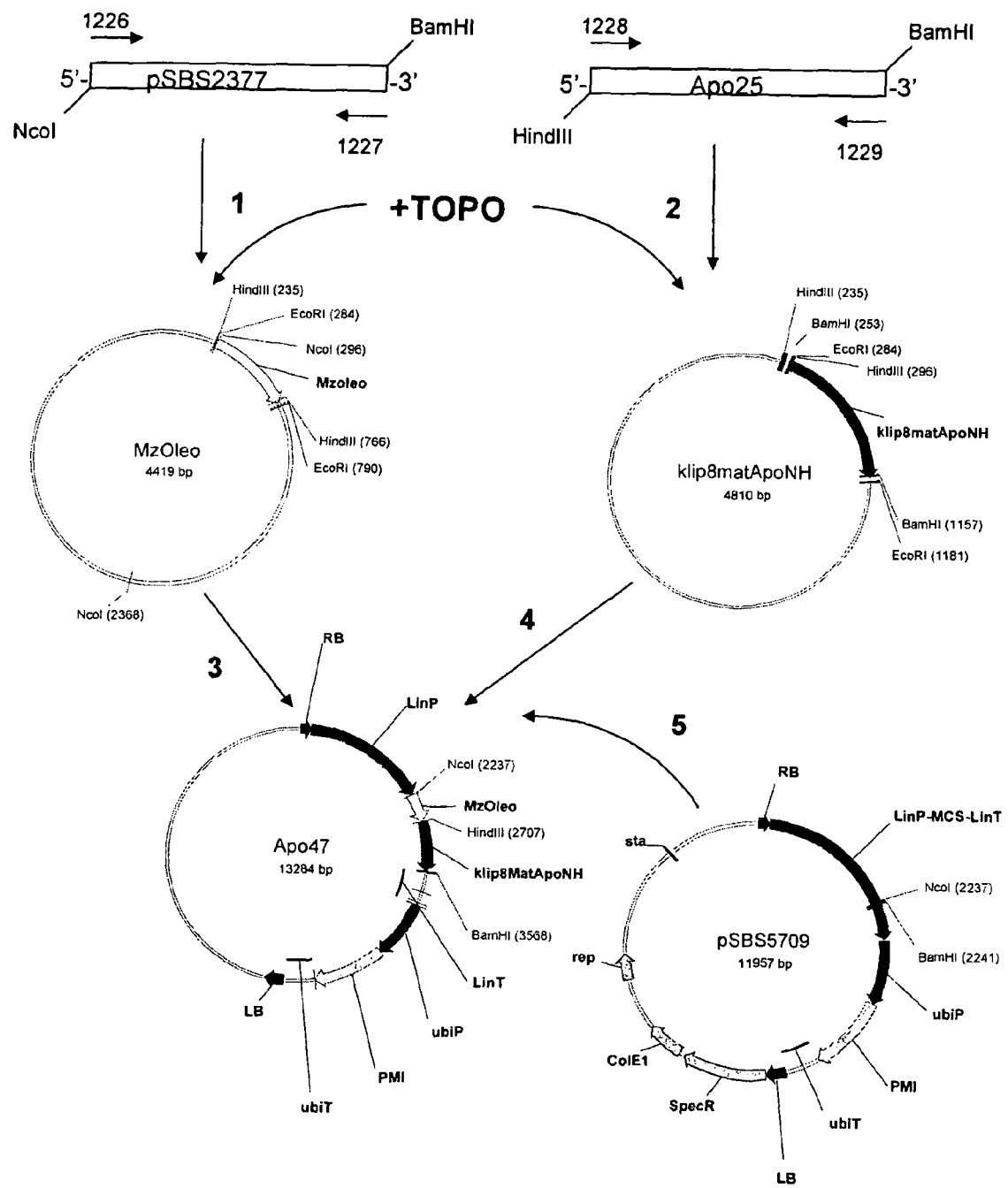
FIG. 15. Schematic drawing for the cloning strategy for the mature form of the coding region of Apo AI, containing an additional Met residue at start of coding region and a protease cleavage site. Apo47 is fused in-frame with the maize oleosin for targeting to oil bodies.

Apo47 (SEQ ID NO:234) is a seed-preferred clone which is constructed as per FIG. 15. As seen in FIG. 2, the Apo47 clone consists of a seed-preferred promoter and terminator (linin) driving the expression of maize oleosin/klip8/met/Apo AI (SEQ ID NO:235). This construct has a klip8 cleavage sequence (SEQ ID NO:143) to facilitate cleavage of the fusion protein with chymosin. To construct this clone, forward primer 1226 (5'-GCAGCACCATGGCTGATCACCACCG-3') (SEQ ID NO: 236) is used to amplify the coding sequence of maize oleosin from pSBS2377 and adds an NcoI site to the start of gene in combination with reverse primer 1227 (5'-GTGGTGAAGCTTAGACCCCTGCGCC-3') (SEQ ID NO:237) which removes the stop codon of the gene and adds a HindIII site to assist in creating an in-frame translation fusion with klip8/met/Apo AI. The coding sequence of klip8/met/Apo AI from Apo25 is amplified using forward primer 1228 (5'-GCAGCAAAGCTTATGGCTGAGATCAC-3') (SEQ ID NO:238) which amplifies the sequence and adds a HindIII site to the start of gene. Reverse primer 1229 (5'-GTGTGGGATCCTCACTGGGTGTTG-3') (SEQ ID NO:239) adds a BamHI site after the stop codon. The PCR fragments containing the maize oleosin cDNA and klip8/met/Apo AI were ligated into the EcoRI sites of the Topo cloning vector (Invitrogen). Plasmid MzOleo was cut with restriction enzymes NcoI and HindIII. Plasmid klip8/met/Apo AI was cut with HindIII and BamHI. The fragments of MzOleo and klip8/met/Apo AI were ligated together into the NcoI and BamHI sites of the plasmid SBS5709 to create the plasmid Apo47. pSBS5709 contains the linin promoter/terminator from WO 01/16340 flanking a multiple cloning site. pSBS5709 also contains the pmi gene (Miles et al., 1984, Gene 21: 41-48), encoding for phosphomannose isomerase which allows for positive selection on mannose containing selection media. The pmi gene is under the control of the ubiquitin promoter/terminator from *Petroselinum crispum* (Kawalleck et al., 1993, Plant. Mol. Bio., 21: 673-684)) for transformation into *Agrobacterium*. Apo47 is a clone for seed-specific targeting of maize oleosin/klip8/met/Apo AI to the oil bodies and purification using the klip8 cleavage sequence.

Example 2

*Agrobacterium* and *Arabidopsis* Transformation

*Arabidopsis thaliana* cv. Columbia (C24) is used for all the experiments. Seeds are planted on the surface of a soil mixture (two-thirds Redi-earth and one-third perlite with a pH=6.7) or an *Arabidopsis* soil mixture supplied by Lehle Seeds (perlite, vermiculite, peat, terra-green, with a pH=5.5) in 4 inch pots. The seedlings are allowed to grow to a rosette stage of 6-8 leaves to a diameter of approximately 2.5 cm. These seedlings are transplanted into 4 inch pots containing the above soil mixture, covered with window screen material which has five 1 cm diameter holes cut into the mesh; one in each of the corners, and one in the center. The pots are placed inside a dome at 4° C. for four days for a cold treatment and subsequently moved to 24° C. growth room with constant light at about 150 μE and 50% relative humidity. The plants are irrigated at 2-3 day interval and fertilized weekly with 1% of Peters 20-20-20. Each pot contains five plants. When plants reach about 2 cm in height, the primary bolts are cut to encourage the growth of secondary and tertiary bolts. 4 to 5 days after cutting the primary bolts, the plants are ready to be infected with *Agrobacterium*. The plasmid was transformed into electrocompetent *Agrobacterium* EHA101. The pots with *Arabidopsis* plants are inverted and infected with 500 ml of a re-suspension an overnight *Agrobacterium* culture containing the plant transformation vector of interest for 20 seconds. It is critical that the *Agrobacterium* culture contains 5% sucrose and 0.05% of the surfactant Silwet L-77 (Lehle Seeds). The pots are subsequently covered with a transparent plastic dome for 24 hours to maintain higher humidity. The plants are allowed to grow to maturity and seeds (untransformed and transformed) are harvested. For selection of transgenic lines, the putative transformed seeds are sterilized in a quick wash of 70% ethanol, then 20% commercial bleach for 15 min and then rinsed at least four times with ddH$_2$O. About 1000 sterilized seeds are mixed with 0.6% top agar and evenly spread on a half strength MS plate (Murashige and Skoog, 1962, Physiologia Plantarum 15: 473-497) containing 0.5% sucrose and 80 μM of the herbicide phosphinothricin (PPT) DL. The plates are then placed in a growth room with light regime 8 hr dark and 16 hr light at 24° C. After 7 to 10 days, putative transgenic seedlings are green and growing whereas untransformed seedlings are bleached. After the establishment of roots the putative transgenic seedlings are individually transferred to pots (the individually plants are irrigated in 3 day interval and fertilized with 1% Peters 20-20-20 in 5 day interval) and allowed to grow to maturity. The pots are covered with a transparent plastic dome for three days to protect the sensitive seedlings. After 7 days the seedlings are covered with a seed collector from Lehle Seeds to prevent seed loss due to scattering. Seeds from these transgenic plants are harvested individually and ready for analysis.

Total Leaf Extract Preparation

An *Arabidopsis* leaf was frozen with liquid nitrogen and ground in a 1.5 ml microfuge tube using a drill. 200-250 μl of 0.5M Tris-HCl, pH 7.5 was added and the sample put on ice. 20% SDS was added to a final concentration of 2%. The sample was boiled for 5 minutes and the extract was spun in a microfuge at maximum speed for 5 minutes. The liquid was removed to another microfuge tube and stored at −20° C. Soluble proteins were quantified using the BCA Protein assay (Pierce) and analyzed on a 15% SDS-PAGE followed by Western blotting. An anti-Apo AI or anti-GFP rabbit antiserum was used as the primary antibody; and anti-rabbit-IgG [H+ L]-AP conjugate (Bio-Rad) was used as the secondary antibody.

Total Seed Extract Preparation

Approximately 40 *Arabidopsis* seeds (T2 seed) were ground in 50 uL buffer (50 mM Tris pH 7.5) in microfuge tube using Stir-Pak laboratory mixer. 20% SDS was subsequently added to the sample to a final concentration of 2% and the sample was boiled for 5 minutes and centrifuged at maximum speed for 5 minutes. For loading onto an SDS-PAGE gel, SDS-PAGE 2× loading buffer (100 mM Tris pH 6.8, 20% glycerol, 4% SDS, 2 mg/mL bromophenol blue, 200 mM DTT) and 1M DTT were added to sample, boiled for 5 minutes and centrifuged at maximum speed for 2 minutes.

Example 3

Western Blot Analysis for Apolipoprotein Expression

Constitutive Expression

Apo17

As seen in Example 1, Apo17 (SEQ ID NO:27) is a fusion protein between mature Apo AI and GFP. An ubiquitin promoter and terminator are used for constitutive expression of the construct. Western blot analysis (FIG. 16(A)) using a polyclonal Apo AI antibody detected very low amounts (less than 0.1% of total leaf protein) the Apo-AI/GFP fusion protein in a total leaf extract at a molecular weight of approximately 55 kDa in 9 of the 12 clones. However substantial expression (at least 1% of total seed protein) of the Apo17 fusion protein was detected in a total seed extract (FIG. 16(B)) at approximately 55 kDa in 11 out of 12 clones tested.

Apo18a

As seen in Example 1, Apo18 (SEQ ID NO:29) is a fusion protein between pro-Apo AI and GFP. An ubiquitin promoter and terminator are used for expression of the construct. Western blot analysis (FIG. 17(A)) using a polyclonal Apo AI antibody detected very low amounts (less than 0.1% of total leaf protein) of the pro-Apo AI/GFP fusion protein in a total leaf extract at a molecular weight of approximately 56 kDa in 3 of the 12 clones tested. However substantial expression (at least 1% of total seed protein) of the Apo18 fusion protein was detected in a total seed extract (FIG. 17(B)) at approximately 56 kDa in all clones tested.

Apo19

As seen in Example 1, Apo19 (SEQ ID NO:31) is a fusion protein between Apo AI and GFP. An ubiquitin promoter and terminator are used for expression of the construct and the PRS signal peptide is used for the targeted expression of the fusion protein to the ER. Western blot analysis (FIG. 18(A)) using a polyclonal Apo AI antibody detected very low levels (less than 0.1% of total leaf protein) of the Apo AI/GFP fusion protein in a total leaf extract at a molecular weight of approximately 58 kDa in 10 of the 12 clones tested. However substantial expression (at least 1% of total seed protein) of the Apo19 fusion protein was detected in a total seed extract (FIG. 18(B)) at approximately 58 kDa in 17 of the 18 clones tested.

Apo20

Figure 19:
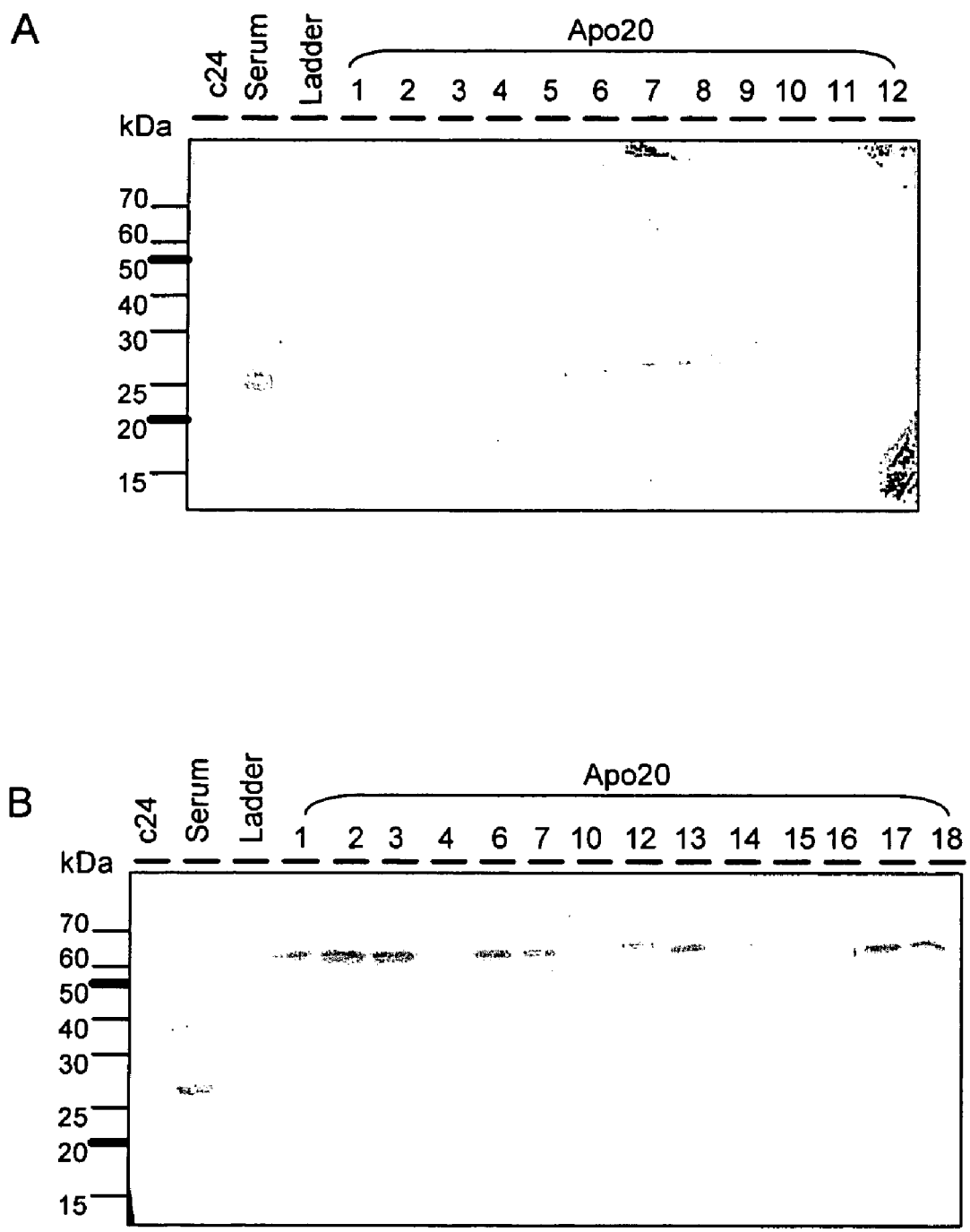
FIG. 19. Westerns of total leaf protein (A) (25 ug) and total seed protein (B) (50 ug) with polyclonal Apo AI antibody. Apo20 is ubi-PRS-pro-Apo AI-GFP construct. c24 leaf (25 ug) and seed protein (50 ug) were used as a negative control and 0.5 ug of human blood serum protein was used as a positive control.

As seen in Example 1, Apo20 (SEQ ID NO:35) is a fusion protein between pro-Apo AI and GFP. An ubiquitin promoter and terminator are used for expression of the construct and the PRS signal peptide is used for the targeted expression of the fusion protein to the ER. Western blot analysis (FIG. 19(A)) using a polyclonal Apo AI antibody detected very low levels (less than 0.1% of total leaf protein) of the pro-Apo AI/GFP fusion protein in a total leaf extract at a molecular weight of approximately 59 kDa in 3 of the 12 clones tested. However substantial expression (at least 1% of total seed protein) of the Apo20 fusion protein was detected in a total seed extract (FIG. 19(B)) at approximately 59 kDa in 16 of the 18 clones tested.

Seed-Specific Expression

Apo10

As seen in Example 1, Apo10 (SEQ ID NO:10) is a fusion protein between mature Apo AI and GFP. A phaseolin promoter and terminator are used for seed-specific expression of the construct. Western blot analysis (FIG. 20(A)) using a polyclonal GFP antibody detected the Apo AI/GFP fusion protein in a total seed extract at a molecular weight of approximately 55 kDa in 7 of the 10 clones tested.

Apo11

As seen in Example 1, Apo11 (SEQ ID NO:16) is a fusion protein between pro-Apo AI and GFP. A phaseolin promoter and terminator are used for seed-specific expression of the construct. Western blot analysis (FIG. 20(B)) using a polyclonal GFP antibody detected the pro-Apo AI/GFP fusion protein in a total seed extract at a molecular weight of approximately 56 kDa in 10 of the 14 clones tested.

Apo12

As seen in Example 1, Apo12 (SEQ ID NO:19) is a fusion protein between oleosin, mature Apo AI and GFP. A phaseolin promoter and terminator are used for seed-specific expression of the construct. Western blot analysis (FIG. 21(A)) using a polyclonal GFP antibody detected the Apo AI/GFP fusion protein in a total seed extract at a molecular weight of approximately 74 kDa in all of the 17 clones tested.

Apo13

As seen in Example 1, Apo13 (SEQ ID NO:21) is a fusion protein between oleosin, pro-Apo AI and GFP. A phaseolin promoter and terminator are used for seed-specific expression of the construct. Western blot analysis (FIG. 21(B)) using a polyclonal GFP antibody detected the oleosin/pro-Apo AI/GFP fusion protein in a total seed extract at a molecular weight of approximately 75 kDa in all 18 of the clones tested.

Apo15

As seen in Example 1, Apo15 (SEQ ID NO:23) is a fusion protein between mature Apo AI and GFP. A phaseolin promoter and terminator are used for seed-specific expression of the construct and the PRS signal peptide is used for the targeted expression of the fusion protein to the secretory system. Western blot analysis (FIG. 22(A)) using a polyclonal GFP antibody detected the Apo AI/GFP fusion protein in a total seed extract at a molecular weight of approximately 58 kDa in 9 of the 10 clones tested.

Apo16

As seen in Example 1, Apo16 (SEQ ID NO:25) is a fusion protein between pro-Apo AI and GFP. A phaseolin promoter and terminator are used for seed-specific expression of the construct and the PRS signal peptide is used for the targeted expression of the fusion protein to the secretory pathway. Western blot analysis (FIG. 22(B)) using a polyclonal GFP antibody detected the pro-Apo AI/GFP fusion protein in a total seed extract at a molecular weight of approximately 59 kDa in 10 of the 13 clones tested.

Apo21

As seen in Example 1, Apo21 (SEQ ID NO:37) is Apo AI. A phaseolin promoter and terminator are used for seed-specific expression of the construct. Western blot analysis (FIG. 23(A)) using a polyclonal Apo AI antibody was used to detect the Apo AI protein in a total seed extract. The expected molecular weight was approximately 28 kDa. In the 12 clones tested, a number of different proteins were detected with the Apo AI antibody which ranged from approximately 25 kDa to upwards of 55 kDa. It should be noted that the expression of Apo AI was detrimental to the health of the plants (i.e. stunted siliques and the absence of seeds).

Apo22

As seen in Example 1, Apo22 (SEQ ID NO:41) is pro-Apo AI. A phaseolin promoter and terminator are used for seed-specific expression of the construct. Western blot analysis (FIG. 23(B)) using a polyclonal Apo AI antibody was used to detect the Apo AI protein in a total seed extract. The expected molecular weight was approximately 29 kDa. In the 6 clones tested, a number of different proteins were detected with the Apo AI antibody which ranged from approximately 25 kDa to upwards of 55 kDa. Clone 22-3 has a protein of the appropriate molecular weight. It should be noted that the expression of pro-Apo AI was somewhat detrimental to the health of the plants with an intermediate phenotype when compared to the health of plants expressing constructs Apo21, Apo29 and Apo30 versus Apo23.

Apo23

As seen in Example 1, Apo23 (SEQ ID NO:44) is a fusion protein between oleosin and Apo AI. A phaseolin promoter and terminator are used for seed-specific expression of the construct. Western blot analysis (FIG. 24(A)) using a polyclonal Apo AI antibody detected the oleosin/Apo AI fusion protein in a total seed extract at a molecular weight of approximately 47 kDa in 4 of the 5 clones tested.

Apo24

As seen in Example 1, Apo24 (SEQ ID NO:46) is a fusion protein between oleosin and pro-Apo AI. A phaseolin promoter and terminator are used for seed-specific expression of the construct. Western blot analysis (FIG. 24(B)) using a polyclonal Apo AI antibody detected the oleosin/Apo AI fusion protein in a total seed extract at a molecular weight of approximately 48 kDa in all 7 clones tested.

Apo25

As seen in Example 1, Apo25 (SEQ ID NO:48) is a fusion protein between oleosin and Apo AI(+Met) with a klip8 cleavage sequence separating the two components. A phaseolin promoter and terminator are used for seed-specific expression of the construct. Western blot analysis (FIG. 25(A)) using a polyclonal Apo AI antibody detected the oleosin-klip8-Apo AI(+Met) fusion protein in a total seed extract at a molecular weight of approximately 51 kDa in all 4 of the clones tested.

Apo26

As seen in Example 1, Apo26 (SEQ ID NO:51) is a fusion protein between oleosin and pro-Apo AI(+Met) with a klip8 cleavage sequence separating the two components. A phaseolin promoter and terminator are used for seed-specific expression of the construct. Western blot analysis (FIG. 25(B)) using a polyclonal Apo AI antibody detected the oleosin-klip8-proApo AI(+Met) fusion protein in a total seed extract at a molecular weight of approximately 52 kDa in all 11 of the clones tested.

Apo28

As seen in Example 1, Apo28 (SEQ ID NO:60) is a fusion protein between oleosin and pro-Apo AI with a klip8 cleavage sequence separating the two components. A phaseolin promoter and terminator are used for seed-specific expression of the construct. Western blot analysis (FIG. 26(A)) using a polyclonal Apo AI antibody detected the oleosin-klip8-pro-Apo AI fusion protein in a total seed extract at a molecular weight of approximately 52 kDa in all 7 of the clones tested.

Apo29

As seen in Example 1, Apo29 (SEQ ID NO:63) is Apo AI. A phaseolin promoter and terminator are used for seed-specific expression of the construct and the PRS signal peptide is used for the targeted expression of the protein to the secretory pathway. Western blot analysis (FIG. 26(B)) using a polyclonal Apo AI antibody was used to detect the Apo AI protein in a total seed extract. The expected molecular weight was approximately 31 kDa. In the 10 clones tested, only 1 clone had a protein detected but the molecular weight was in the range of 37 kDa. It should be noted that the expression of Apo AI was detrimental to the health of the plants (i.e. stunted siliques and the absence of seeds).

Apo30

Figure 27:
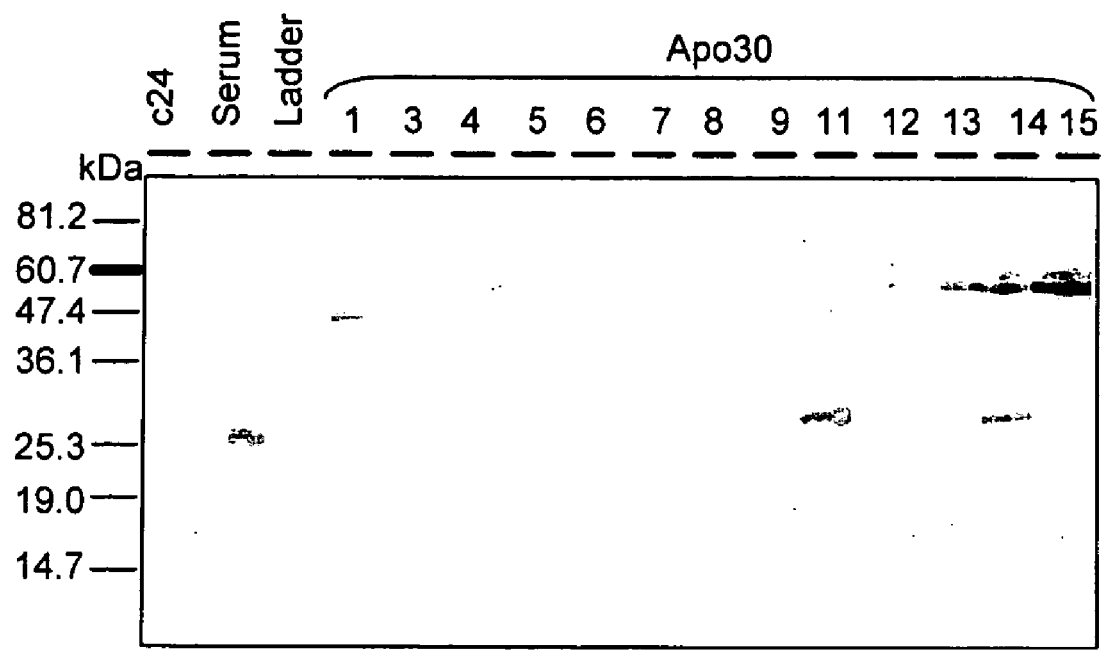
FIG. 27. Western of total seed protein (50 ug) with polyclonal Apo AI antibody. (A) Apo30 is pha-PRS-pro-Apo AI. c24 seed protein (50 ug) was used as a negative control and 0.5 ug of human blood serum protein was used as a positive control.

As seen in Example 1, Apo30 (SEQ ID NO:65) is pro-Apo AI. A phaseolin promoter and terminator are used for seed-specific expression of the construct and the PRS signal peptide is used for the targeted expression of the fusion protein to the secretory pathway. Western blot analysis (FIG. 27) using a polyclonal Apo AI antibody was used to detect the Apo AI protein in a total seed extract. The expected molecular weight was approximately 32 kDa. In the 13 clones tested, a number of different proteins were detected with the Apo AI antibody which ranged from approximately 25 kDa to upwards of 55 kDa. It should be noted that the expression of pro-Apo AI was detrimental to the health of the plants (i.e. stunted siliques and the absence of seeds).

Apo32

As seen in Example 1, Apo32 (SEQ ID NO:69) is a fusion protein between the D9 scFV antibody and pro-Apo AI. A phaseolin promoter and terminator are used for seed-specific expression of the construct and the PRS signal peptide is used for the targeted expression of the fusion protein to the secretory pathway. Western blot analysis (FIG. 28(A)) using a polyclonal Apo AI antibody detected the D9 scFV-pro-Apo AI fusion protein in a total seed extract at a molecular weight of approximately 59 kDa in all 5 of the clones tested.

Apo33

As seen in Example 1, Apo33 (SEQ ID NO:71) is a fusion protein between the D9 scFV antibody and Apo AI(+met). A phaseolin promoter and terminator are used for seed-specific expression of the construct and the PRS signal peptide is used for the targeted expression of the fusion protein to the secretory pathway. Western blot analysis (FIG. 28(B)) using a polyclonal Apo AI antibody detected the D9 scFV-Apo AI(+met) fusion protein in a total seed extract at a molecular weight of approximately 59 kDa in 1 of the 8 clones tested.

Apo34

Figure 29:
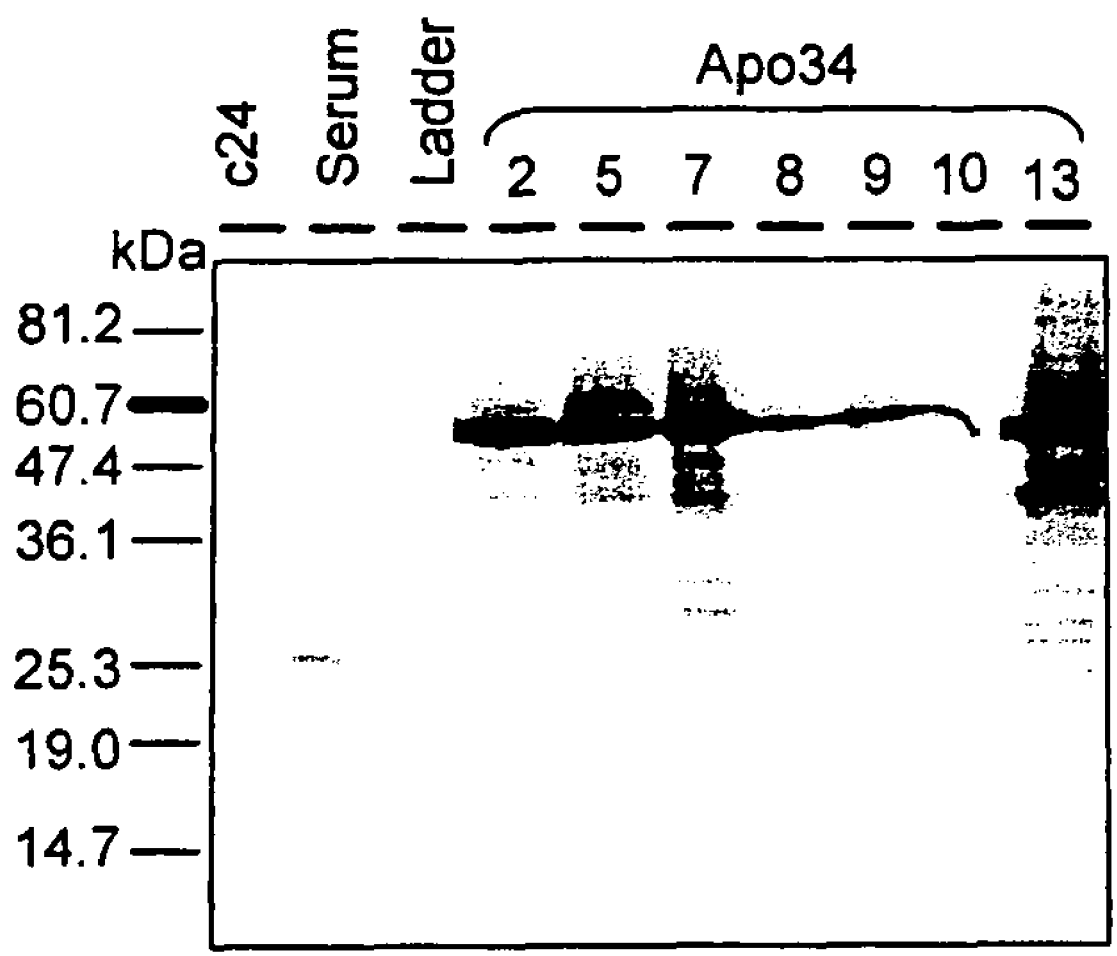
FIG. 29. Western of total seed protein (50 ug) with polyclonal Apo AI antibody. Apo34 is pha-PRS-D9 scFv-pro-Apo AI(+met). c24 seed protein (50 ug) was used as a negative control and 0.5 ug of human blood serum protein was used as a positive control.

As seen in Example 1, Apo34 (SEQ ID NO:73) is a fusion protein between the D9 scFV antibody and pro-Apo AI(+met). A phaseolin promoter and terminator are used for seed-specific expression of the construct and the PRS signal peptide is used for the targeted expression of the fusion protein to the secretory pathway. Western blot analysis (FIG. 29) using a polyclonal Apo AI antibody detected the D9 scFV-pro-Apo AI(+met) fusion protein in a total seed extract at a molecular weight of approximately 59 kDa in 6 of the 7 clones tested.

Apo36

As seen in Example 1, Apo36 (SEQ ID NO:78) is a fusion protein between the D9 scFV antibody and pro-Apo AI. A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 30(A)) using a polyclonal Apo AI antibody detected the D9 scFV-pro-Apo AI-KDEL fusion protein in a total seed extract at a molecular weight of approximately 60 kDa in all 13 of the clones tested.

Apo37

As seen in Example 1, Apo37 (SEQ ID NO:80) is a fusion protein between the D9 scFV antibody and Apo AI(+met). A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 30(B)) using a polyclonal Apo AI antibody detected the D9 scFV-Apo AI(+met)-KDEL fusion protein in a total seed extract at a molecular weight of approximately 59 kDa in all 15 of the clones tested.

Apo38

As seen in Example 1, Apo38 (SEQ ID NO:82) is a fusion protein between the D9 scFV antibody and pro-Apo AI(+met). A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 31A) using a polyclonal Apo AI antibody detected the D9 scFV-pro-Apo AI(+met)-KDEL fusion protein in a total seed extract at a molecular weight of approximately 60 kDa in 9 of the 11 clones tested.

Apo39

As seen in Example 1, Apo39 (SEQ ID NO:83) is a fusion protein between the D9 scFV antibody, KLIP8 and Apo AI. A phaseolin promoter and terminator are used for seed-specific expression of the construct, the PRS signal peptide is used for the targeted expression of the fusion protein to the secretory pathway and KLIP8 is used as a cleavable linker. Western blot analysis (FIG. 31B) using a polyclonal Apo AI antibody detected the D9 scFV-KLIP8-Apo AI fusion protein in a total seed extract at a molecular weight of approximately 55 kDa in all 12 of the clones tested.

Apo40

As seen in Example 1, Apo40 (SEQ ID NO:87) is a fusion protein between the D9 scFV antibody and pro-Apo AI with a klip8 cleavage sequence separating the two components. A phaseolin promoter and terminator are used for seed-specific expression of the construct and the PRS signal peptide is used for the targeted expression of the fusion protein to the secretory pathway. Western blot analysis (FIG. 32(A)) using a polyclonal Apo AI antibody detected the D9 scFV-klip8-pro-Apo AI fusion protein in a total seed extract at a molecular weight of approximately 63 kDa in 12 of the 13 clones tested.

Apo41

As seen in Example 1, Apo41 (SEQ ID NO:89) is a fusion protein between the D9 scFV antibody and Apo AI(+met) with a klip8 cleavage sequence separating the two components. A phaseolin promoter and terminator are used for seed-specific expression of the construct and the PRS signal peptide is used for the targeted expression of the fusion protein to the secretory pathway. Western blot analysis (FIG. 32(B)) using a polyclonal Apo AI antibody detected the D9 scFV-klip8-Apo AI(+met) fusion protein in a total seed extract at a molecular weight of approximately 63 kDa in 8 of the 9 clones tested.

Apo42

Figure 33:
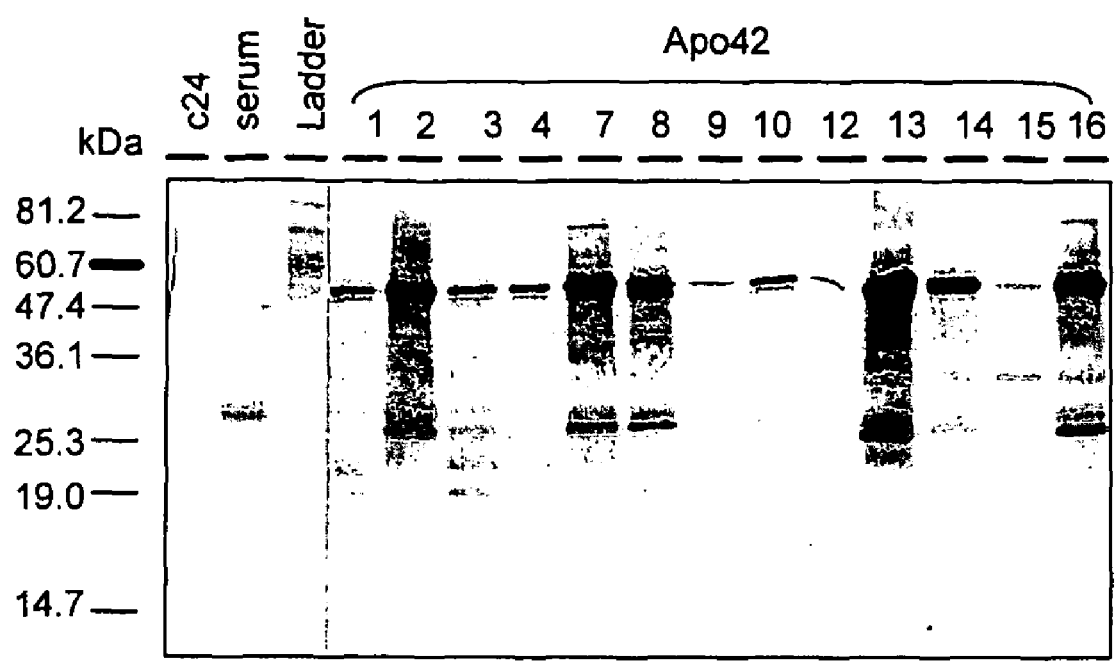
FIG. 33. Westerns of total seed protein (50 ug) with polyclonal Apo AI antibody. (A) Apo42 is pha-PRS-D9 scFv-klip8-pro-Apo AI(+met). c24 seed protein (50 ug) was used as a negative control and 0.5 ug of human blood serum protein was used as a positive control.

As seen in Example 1, Apo42 (SEQ ID NO:91) is a fusion protein between the D9 scFV antibody and pro-Apo AI(+met) with a klip8 cleavage sequence separating the two components. A phaseolin promoter and terminator are used for seed-specific expression of the construct and the PRS signal peptide is used for the targeted expression of the fusion protein to the secretory pathway. Western blot analysis (FIG. 33(A)) using a polyclonal Apo AI antibody detected the D9 scFV-klip8-pro-Apo AI(+met) fusion protein in a total seed extract at a molecular weight of approximately 64 kDa in all of the 13 clones tested.

Apo44

As seen in Example 1, Apo44 (SEQ ID NO:95) is a fusion protein between the D9 scFV antibody and pro-Apo AI. A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 34(A)) using a polyclonal Apo AI antibody detected the D9 scFV-pro-Apo AI-KDEL fusion protein in a total seed extract at a molecular weight of approximately 64 kDa in 4 of the 15 clones tested.

Apo45

As seen in Example 1, Apo45 (SEQ ID NO:97) is a fusion protein between the D9 scFV antibody and Apo AI(+met). A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 34(B)) using a polyclonal Apo AI antibody detected the D9 scFV-Apo AI(+met)-KDEL fusion protein in a total seed extract at a molecular weight of approximately 63 kDa in all 12 of the clones tested.

Apo46

Figure 35:
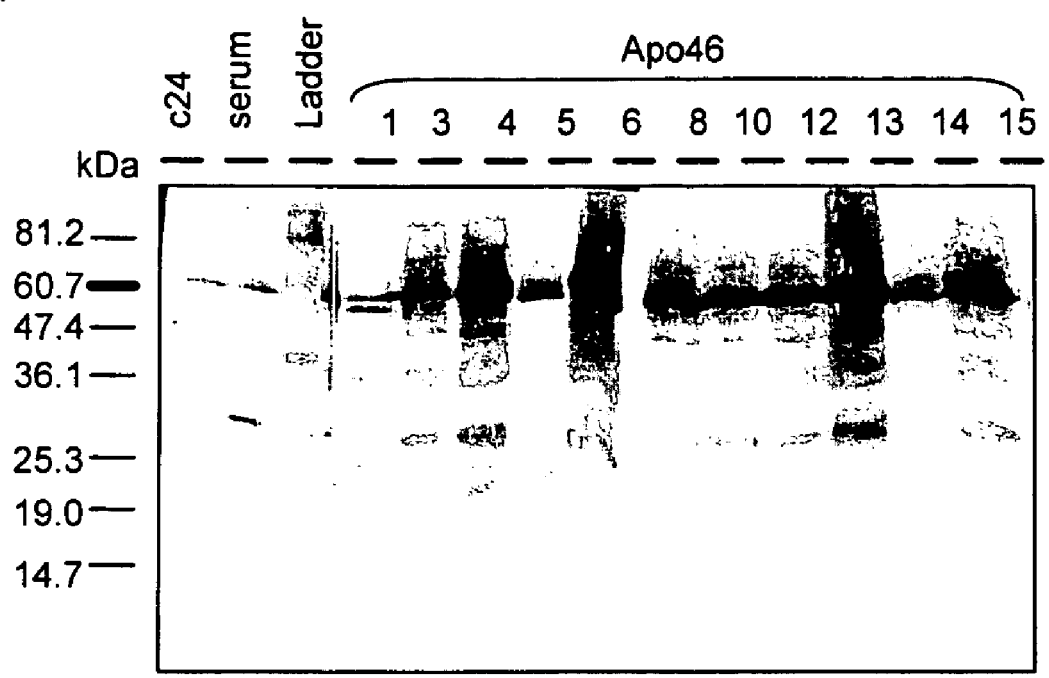
FIG. 35. Western of total seed protein (50 ug) with polyclonal Apo AI antibody. (A) Apo46 is pha-PRS-D9 scFv-klip8-pro-Apo AI(+met)-KDEL. c24 seed protein (50 ug) was used as a negative control and 0.5 ug of human blood serum protein was used as a positive control.

As seen in Example 1, Apo46 (SEQ ID NO:99) is a fusion protein between the D9 scFV antibody and pro-Apo AI(+met) with a klip8 cleavage sequence separating the two components. A phaseolin promoter and terminator are used for seed-specific expression of the construct, the PRS signal peptide is used for the targeted expression of the fusion protein to the secretory pathway and KDEL retention signal is used to retain the polypeptide in the ER. Western blot analysis (FIG. 35(A)) using a polyclonal Apo AI antibody detected the D9 scFV-klip8-pro-Apo AI(+met)-KDEL fusion protein in a total seed extract at a molecular weight of approximately 64 kDa in 10 of the 11 clones tested.

Example 4

Western Blot Analysis for Apolipoprotein Localization

The isolation of oil bodies was performed as previously described (van Rooijen & Moloney, 1995) with the following modifications. Briefly, 250 mg of dry mature seeds were surface sterilized with 70% ethanol, rinsed twice with sterile water and once with a phosphate buffer (100 mM phosphate buffer pH 8 with 0.5M NaCl). After washing, the seeds were resuspended in phosphate buffer for analytical analysis and then ground using a sterilized mortar and pestle. After grinding, the sample was transferred to a centrifuge bottle and centrifuged for 15 min at 10,000 g at RT. After centrifugation, the fat pad containing the oil bodies was removed from the aqueous phase (AQ) and transferred to a 1.5 mL microfuge tube. The oil bodies were resuspended in a low stringency phosphate buffer (100 mM phosphate buffer pH 8 with 0.5M NaCl). The sample was centrifuged for 15 minutes at 10,000 g at 4° C. and the undertatant removed. The undernatant (PW) and phosphate washed oil bodies (PO) were tested for the presence of the apolipoprotein. The oil bodies were subsequently resuspended in a high stringency urea buffer (8M Urea in 100 mM Na-Carbonate buffer pH 8). The sample was centrifuged for 15 min at 10,000 g at 4° C. and the undernatant removed. The undernatant (UW) and urea washed oil bodies (UO) were tested for the presence of the apolipoprotein. Note that oil bodies are treated with low and high stringency washes in order to remove proteins which associate with the oil bodies. Oleosin resists high stringency washes and remains with the oil body fraction. The microsomal fraction (ER) was obtained by grinding approximately 250 mg of dry seeds in 4 mL of microsome grinding buffer (0.5M Sucrose, 0.2M Hepes-NaOH buffer, pH 7.4), into a slurry with a mortar and pestle. The slurry was centrifuged at 10,000 g for 30 min at 4° C. The supernatant was transferred into new tubes, and recentrifuged at 10,000 g for another 30 min at 4° C. to completely remove oil bodies. The supernatant was then centrifuged for 2 hrs at 100,000 g at 4° C. using an ultracentrifuge with a swinging bucket rotor. The pellet was washed with microsome grinding buffer, quickly centrifuged for 5 min for 10,000 g and resuspended in 10-15 uL of microsome grinding buffer and stored at −20° C.

Untargeted Constructs

As seen in FIG. 36A, pro- (Apo11) and mature (Apo10) Apo AI-GFP fusions, without additional targeting signals, were examined in the different fractions. Apo10 shows that while the mature Apo AI-GFP fusion protein is detected in all cellular fractions, there appears to be more protein accumulation with the oil bodies washed with phosphate buffer and the urea wash fraction. This suggests that while Apo10 does possess some affinity to oil bodies, a high stringency wash is sufficient to remove it from the surface of the oil bodies. Apo11 shows that the presence of the native pro-sequence of Apo AI targets the Apo AI-GFP fusion protein to the oil body fraction to a greater extent than when the pro-peptide is missing, and that the protein remains bound to the oil-bodies even when high stringency washes are used. It appears that the pro-Apo AI peptide acts as an 'anchoring' sequence to maintain pro-Apo AI on the surface on the oil bodies. Multiple lower molecular weight bands can be detected in these fractions, which may be degradation products.

Oil Body Targeted Constructs

This pattern of tight association of Apo AI-GFP fusion protein with oil bodies can also be seen in the oil body targeted constructs (FIG. 36B). Pro- (Apo13) and mature (Apo12) Apo AI-GFP fusions are fused in-frame to the C-terminus of oleosin, which serves as a targeting signal to oil bodies. As seen previously for the untargeted pro-Apo AI-GFP fusion, the protein is predominantly associated with the phosphate and urea-washed oil body fractions. Multiple lower molecular weight bands are also detected in these fractions, indicating that there is something unique to the oil body associated fractions which leads to an accumulation of possible degradation products.

Secretory System Targeted Constructs

Figure 37:
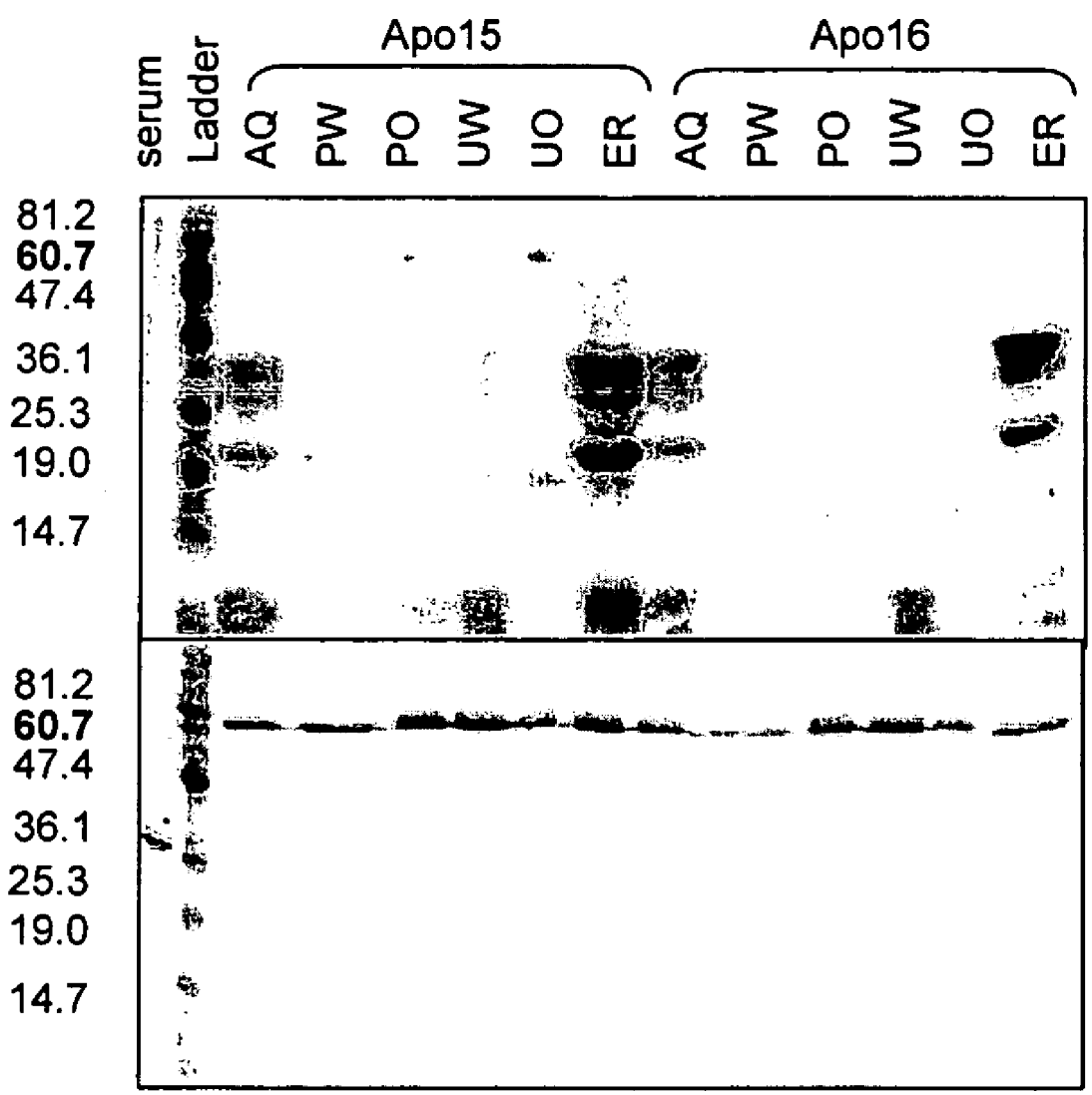
FIG. 37. Examination of secreted pro- and mature Apo AI-GFP association with specific cellular fractions from seeds. Western blot analysis using the anti-Apo AI antibody and approximately equal quantities of total protein (50 _g) isolated from the aqueous (AQ) fraction, phosphate (PW) and urea (UW) washes of oil bodies (PO and UO respectively, with approximately 20 μg of total oil body protein used) and the microsomal (ER) fraction from mature seeds. Ponceau-S staining of the immunoblot shows relative protein amounts loaded on the gel (upper panel). Human blood serum (0.5 μg) was used as a positive control for Apo AI expression. Apo15 is PRS-Apo AI-GFP. Apo16 is PRS-pro-Apo AI-GFP.

The PRS signal peptide (Sijmons et al., 1990, Bio/technology, 8: 217-221) which targets proteins to the secretory pathway was added as an in-frame translational fusion to the pro- (Apo16) and mature (Apo15) forms of Apo AI-GFP (FIG. 37). Normally, this results in the secretion of the fusion protein into the extracellular space (apoplast) of plant cells. However, when the cellular fractions of the two constructs were examined, the Apo AI-GFP fusion protein was detected in all of the fractions, with more protein being detected in the oil body fractions. A band the size of the recombinant fusion protein can also be observed in the oil body fractions when the Ponceau-S stained immunoblot is examined (FIG. 37, upper panel). The presence of the native pro-sequence of Apo AI did not appear to change the secreted fusion protein's association with a specific cellular fraction. The plant presequence recognition signal (PRS) peptide appears to interfere with the 'anchoring' characteristic of the pro-Apo AI peptide.

Constitutive Expression of Apo AI-GFP in the Leaves

Figure 38:
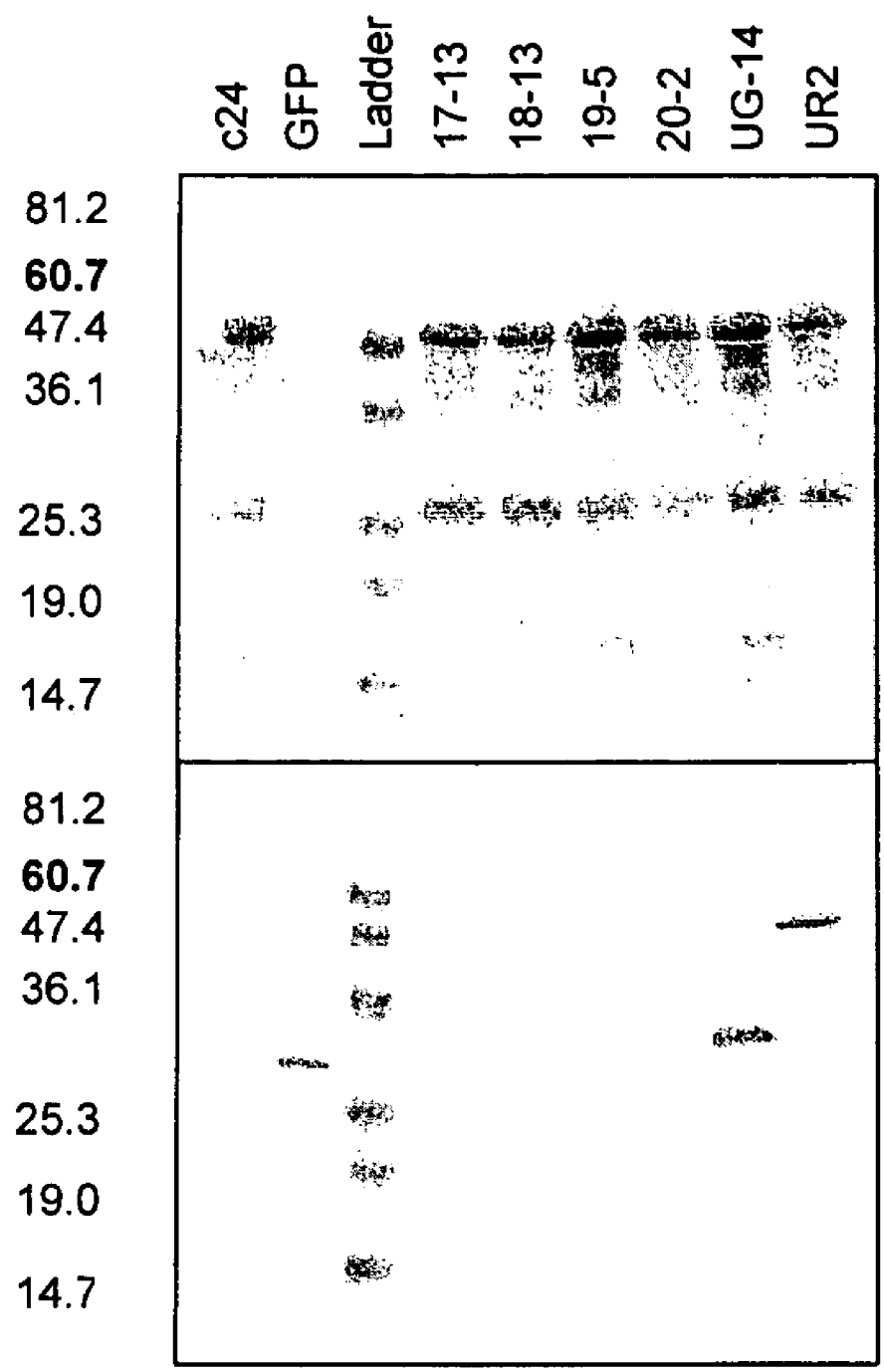
FIG. 38. Constitutive expression of Apo AI-GFP translational fusion constructs in leaves. Western blot analysis using the anti-GFP antibody and approximately equal quantities of total protein (50 μg) isolated from leaves. Ponceau-S staining of the immunoblot shows relative protein amounts loaded on the gel (upper panel). Wild-type (c24) plants were used as a negative control for GFP expression. Purified GFP protein (200 ng) was used as a positive control for GFP. UG-14 and UR2 are included as positive controls for GFP protein accumulation in leaves. The expected masses are as follows: Apo17=55.4 kDa; Apo18=56.4 kDa; Apo19=58.3 kDa; Apo20=59.3 kDa; UG-14=26.8 kDa; UR2=50 kDa.

Leaf tissue that constitutively expressed the untargeted and secreted pro- and mature forms of Apo AI-GFP was examined to determine if the Apo AI-GFP fusion protein could accumulate in non-oil producing tissues. Leaf tissues were homogenized (as described in example 2) from the transgenic plants lines constitutively expressing the untargeted pro- (Apo18) and mature (Apo17) and the secreted pro- (Apo20) and mature (Apo19) forms of Apo AI-GFP and used for immunoblotting. Leaf material was also sampled from wild-type (c24) plants for a negative control, and from UR2 (ubiquitin-driven oleosin-GFP) plants and UG-14 (ubiquitin-driven GFP) plants for positive controls for leaf expression. Similar amounts of protein were separated by SDS-PAGE and the Apo AI-GFP fusion protein was detected by immunoblotting with an anti-GFP antibody (FIG. 38 lower panel).

Faint bands were detected in the non-transformed line, whereas the both the ubiquitin-driven GFP (UG-14) and oleosin-GFP (UR2) fusion are readily detected on the immunoblot by the anti-GFP antibody. However, while a similar amount of leaf protein was loaded on the immunoblot as can be seen by Ponceau-S staining of the membrane (upper panel, FIG. 38), no bands can be detected for any of the Apo AI-GFP fusion protein constructs. The faint band detected in the background of the immunoblot may be due to cross-reactivity with Rubisco, the most prevalent protein found in leaf tissue (Spreitzer R J & Salvucci M E (2002) Rubisco: structure, regulatory interactions, and possibilities for a better enzyme. Annu Rev Plant Biol 53: 449-475.), which can be seen in the Ponceau-S stained panel of the immunoblot by size (55 kDa) according to the molecular weight markers.

Seed Specific Expression of Untargeted and Secreted Apo AI in Seeds

Figure 39:
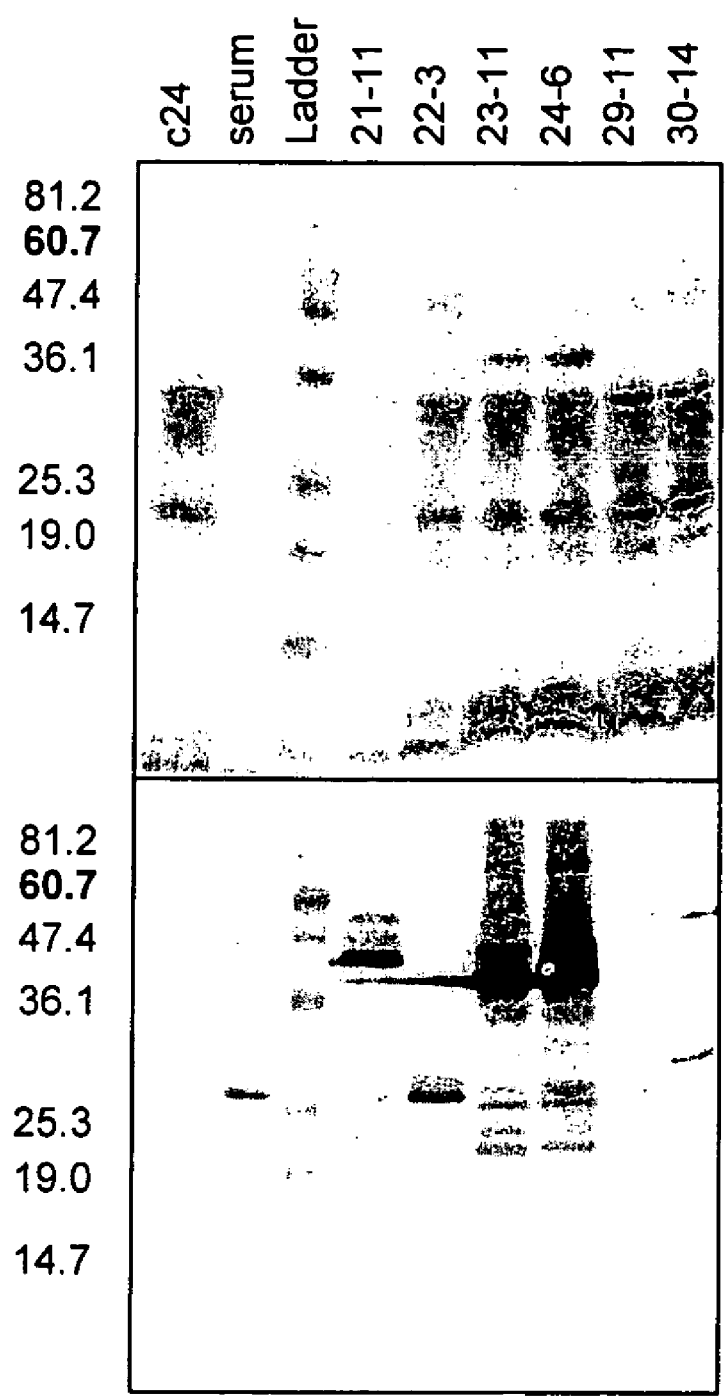
FIG. 39. Seed-specific expression of untargeted and secreted Apo AI in seeds. Western blot analysis using the anti-Apo AI antibody and approximately equal quantities of total protein (50 μg) isolated from mature seeds. Ponceau-S staining of the immunoblot shows relative protein amounts loaded on the gel (upper panel). Wild-type (c24) plants were used as a negative control for Apo AI expression. Human blood serum (0.5 μg) was used as a positive control for Apo AI expression. The expected masses are as follows: Apo21=28.3 kDa; Apo22=29.32 kDa; Apo23=46.9 kDa; Apo24=47.8 kDa; Apo25=51.5 kDa; Apo26=52.5 kDa; Apo27=51.3 kDa; Apo28=52.3 kDa; Apo29=31.3 kDa; Apo30=32.2 kDa.

One transgenic line was selected from each of the T$_2$ generation Apo AI transgenic plants that showed some accumulation of either pro- or mature ApoAI protein in total seed extracts. Of the plant lines that were putative transgenics, only 1 line for the following showed any protein expression: Apo21 (untargeted mature Apo AI), Apo22 (untargeted pro-Apo AI), and Apo29 (secreted mature Apo AI); two lines were found for Apo30 (secreted pro-Apo AI). All transgenic plant lines that contained the constructs Apo23 and Apo24 appeared to express and accumulate the oleosin-Apo AI fusion protein. Similar amounts of protein were separated by SDS-PAGE and the Apo AI protein was detected by immunoblotting with an anti-Apo AI antibody (FIG. 39). A negative control was included for the immunoblot by preparing a similar protein extract from a non-transformed plant (c24). The correct size of band for Apo AI expressed alone (expected molecular weight of 28.3 kDa for mature Apo AI and 29.3 kDa for pro-Apo AI) was only observed in line Apo22-3 (untargeted pro-Apo AI). The predominant band detected in Apo21-11 (untargeted mature Apo AI) is the incorrect size, and while only minor bands are detected in Apo29-11 (secreted mature Apo AI) and Apo30-14 (secreted proApo AI) none are the correct size. However, for both of the oleosin fusions, Apo23-11 (oleosin-mature Apo AI) and Apo24-6 (oleosin-pro-Apo AI), a significant amount of Apo AI fusion protein is detected by anti-Apo AI antibody and can also be detected in the Ponceau-S stained immunoblot (upper panel).

Subcellular Localization of Untargeted Apo AI (Apo22) T3 Seeds

Figure 40:
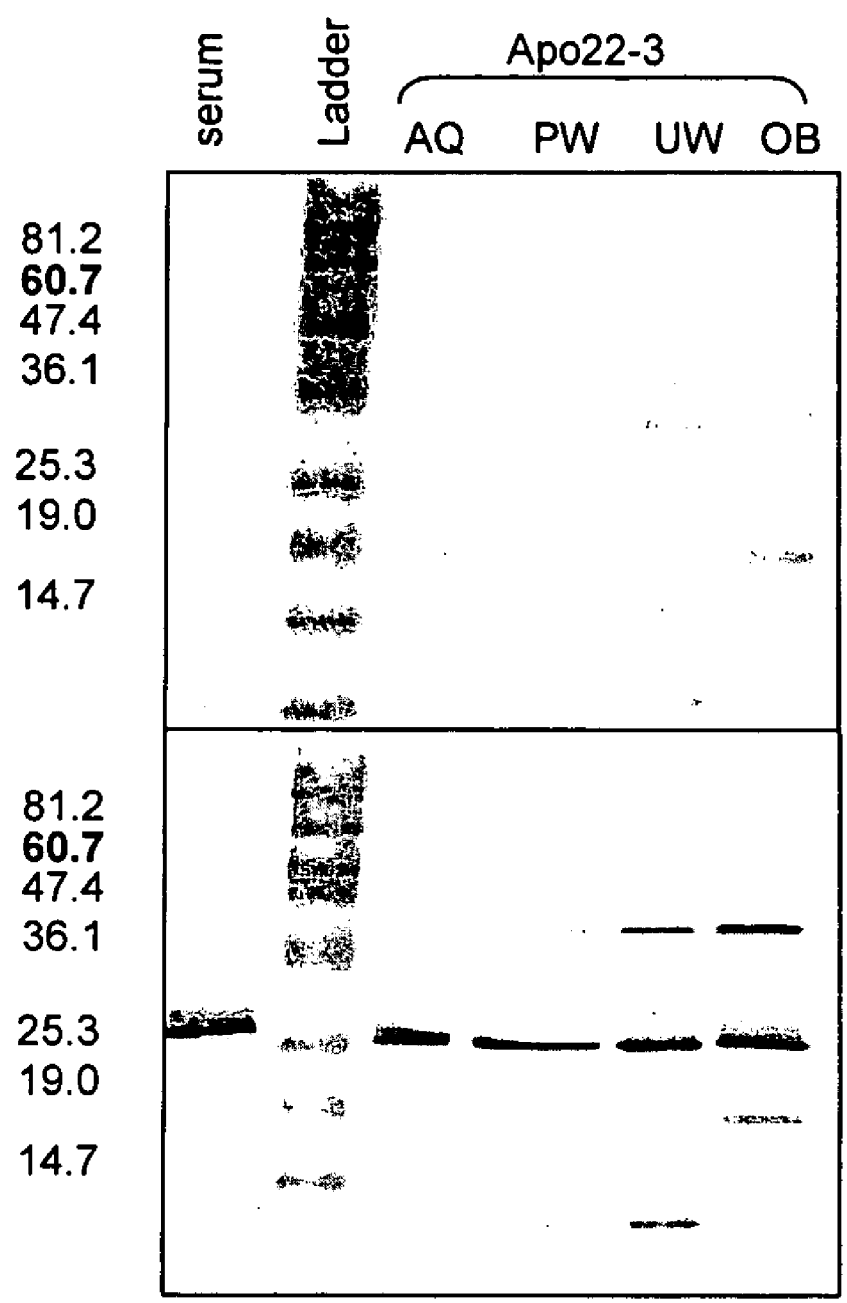
FIG. 40. Examination of subcellular fractions of Apo22-3 (untargeted pro-Apo AI) T3 generation seeds. Western blot analysis using the anti-Apo AI antibody and approximately equal quantities of total protein (50 μg) isolated from the aqueous (AQ) fraction, phosphate (PW) and urea (UW) washes of oil bodies (PO and UO respectively, with approximately 20 μg of total oil bodies used) from mature seeds. Ponceau-S staining of the immunoblot shows relative protein amounts loaded on the gel (upper panel). Human blood serum (0.5 μg) was used as a positive control for Apo AI expression. Molecular weight sizes are indicated on the left.

The seed-specific expression of the pro-form of the untargeted Apo AI protein (Apo22) and its association with a specific cellular fraction was examined in mature seeds (FIG. 40). Seeds were homogenized and treated as described above, and the cellular fractions were subjected to immunoblotting with an antibody against Apo AI. Apo22-3 shows that the presence of the native pro-sequence of Apo AI targets the Apo AI protein to the oil body fraction, and that the protein requires high stringency washes to remove the protein from the oil bodies. Some protein can also be detected in the aqueous phase indicating that not all the pro-Apo AI protein is associated with the oil bodies. Multiple lower molecular weight bands can be detected in these fractions, which may be degradation products.

Example 5

Confocal Microscopy for Apolipoprotein Localization

Immature embryos were dissected out of Apo AI-GFP siliques under sterile water into a Petri dish using forceps and a dissecting microscope. Embryos were removed from the seed coat by gentle pressure on the immature seeds with a glass microscope slide cover. Embryos were transferred by pipette into a 1.5 mL microfuge tube with water added to a final volume of 1 mL. Nile Red (Molecular Probes) was used at a final concentration of 1 μg/μL. Embryos in diluted Nile Red were left to incubate for 15 min in darkness at room temperature. Embryos were rinsed 3 times in sterile water and mounted in water on glass slides for microscopy. Leaf epidermal cells were prepared by simply cutting small portions of leaves (0.5 cm$^2$) with a scalpel and mounting them in water on microscope slides with cover slips. The leaf sections were placed so that the lower epidermis faced upwards (less interference with autofluorescent chloroplasts).

All GFP-dependent fluorescence was analyzed from *Arabidopsis* embryos and leaf epidermal cells mounted in water for microscopic observations and examined with a Zeiss LSM 510 laser scanning confocal microscope (Edmonton, AB). For simultaneous detection of GFP and Nile Red a line-sequential single-tracking mode with the AOTF-controlled excitation with 488 nm and 543 nm light was set at 20% and 100% respectively. A Plan-Appochromat 63×/1.4 Oil DIC objective was used with a 5× scan zoom. The pinhole was optimized for Channel 2 (green) at 94 μm and for Channel 1 (red) at 106 μm.

Figure 41:
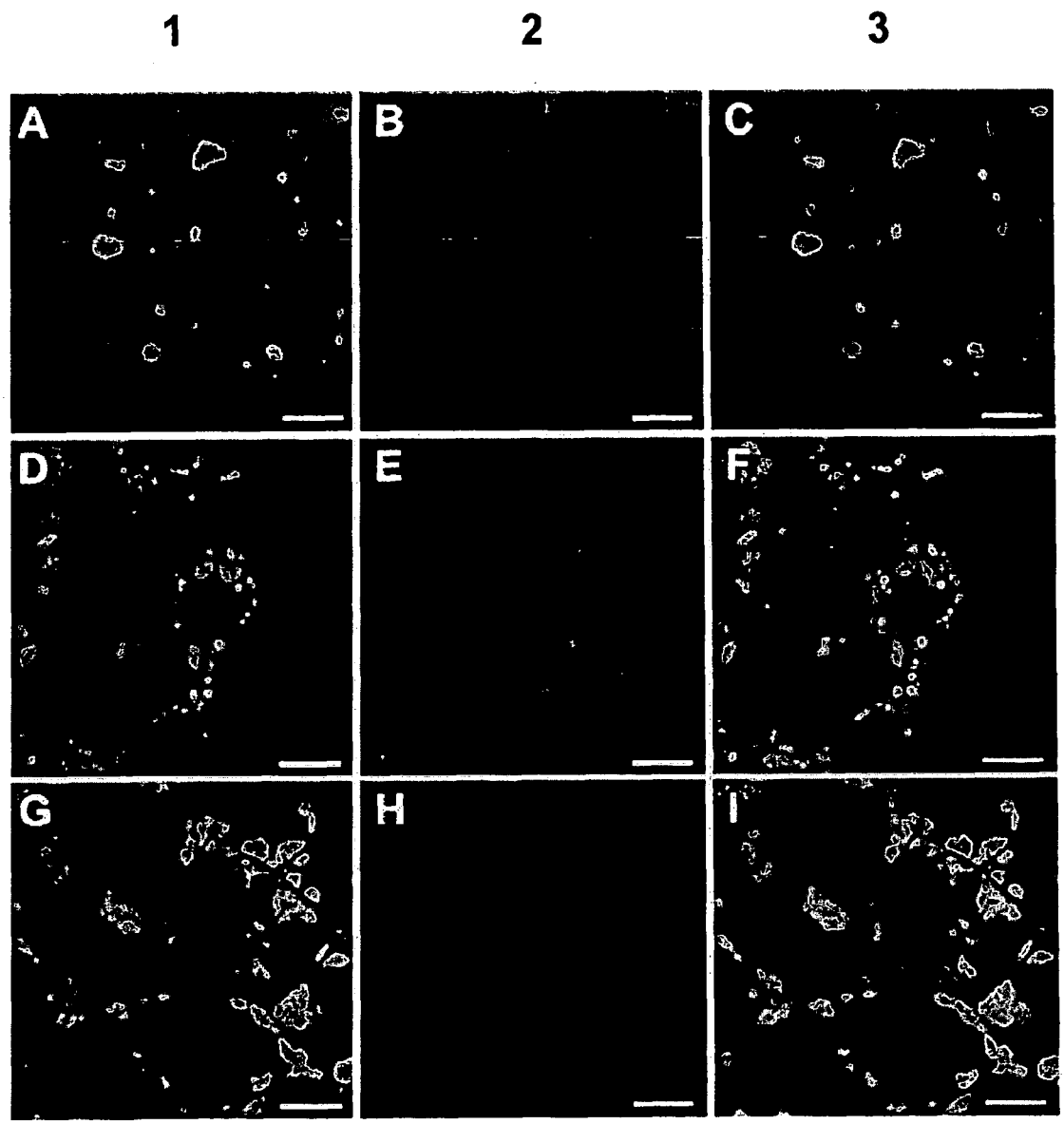
FIG. 41. Confocal micrographs of Apo AI-GFP seed-specific constructs expressed in late cotyledonary stage embryo cells stained with Nile Red. (A-C) Apo10 is untargeted mature Apo AI fused to GFP. (D-F) Apo11 is untargeted pro-Apo AI fused to GFP. (G-I) Apo12 is mature Apo AI fused to GFP targeted to oil bodies using oleosin. (Column 1) Green channel. (Column 2) Red channel. (Column 3) Merged channels. Bar=5 μm.
Figure 42:
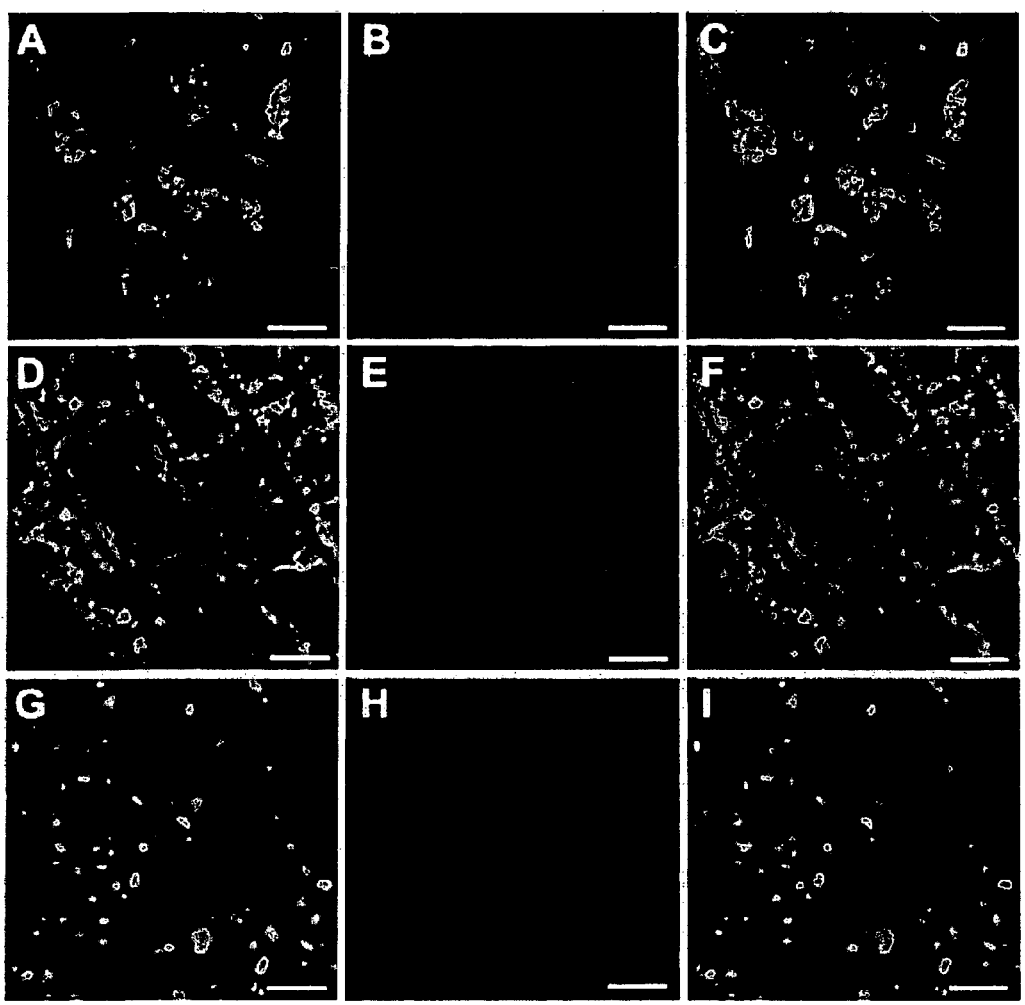
FIG. 42. Confocal micrographs of Apo AI-GFP seed-specific constructs expressed in late cotyledonary stage embryo cells stained with Nile Red. (A-C) Apo13 is pro-Apo AI fused to GFP targeted to oil bodies using oleosin. (D-F) Apo15 is mature Apo AI fused to GFP targeted to the secretory pathway. (G-I) Apo16 is pro-Apo AI fused to GFP targeted to the secretory pathway. (Column 1) Green channel. (Column 2) Red channel. (Column 3) Merged channels. Bar=5 μm.
Figure 43:
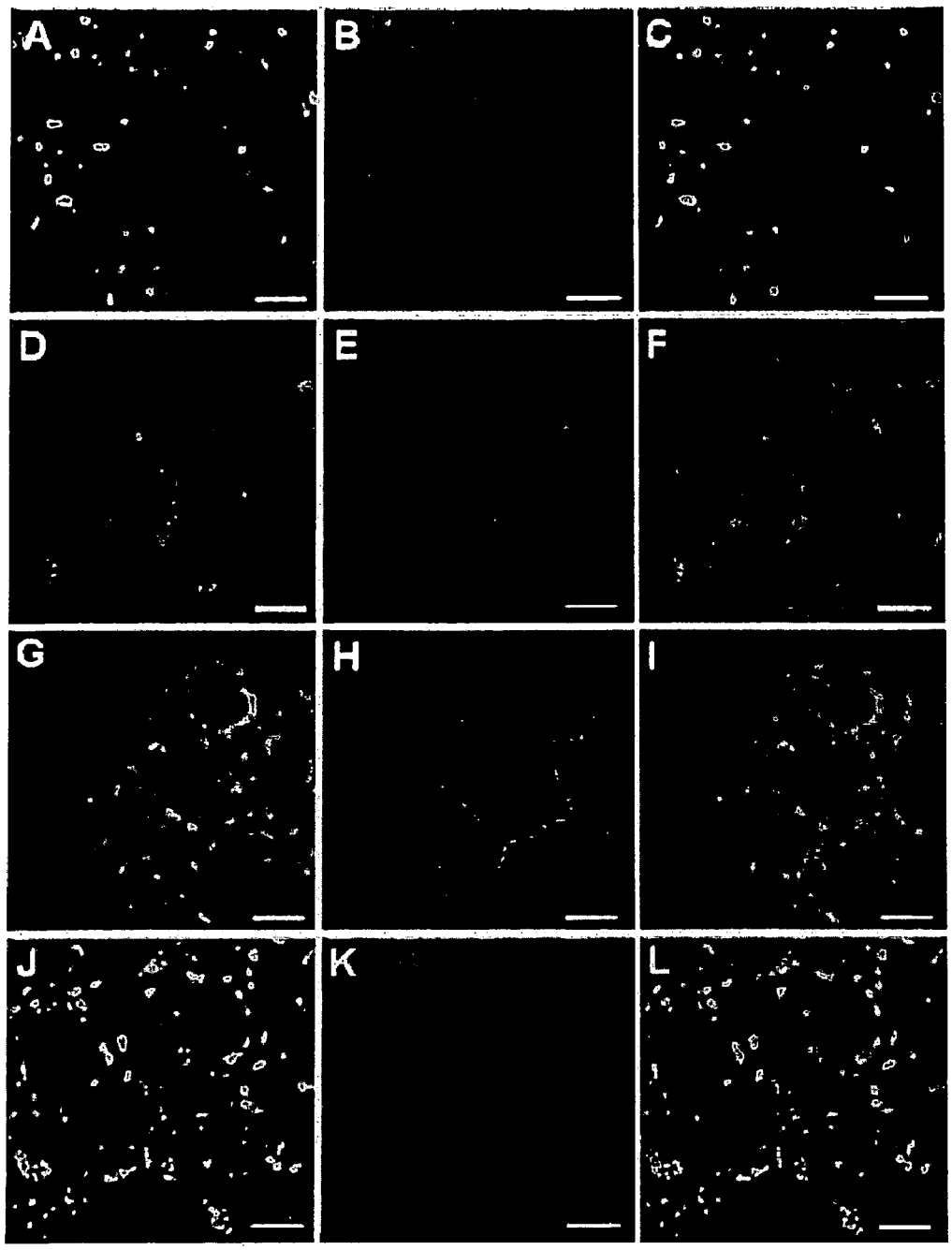
FIG. 43. Confocal micrographs of constitutively expressed untargeted and secreted Apo AI-GFP fusion protein in late cotyledonary stage embryo cells stained with Nile Red. (A-C) Apo17 is untargeted mature Apo AI fused to GFP. (D-F) Apo18 is untargeted pro-Apo AI fused to GFP. (G-H) Apo19 is mature Apo AI fused to GFP targeted to the secretory pathway. (J-L) Apo20 is pro-Apo AI fused to GFP targeted to the secretory pathway. (Column 1) Green channel. (Column 2) Red channel. (Column 3) Merged channels. Bar=5 μm.
Figure 44:
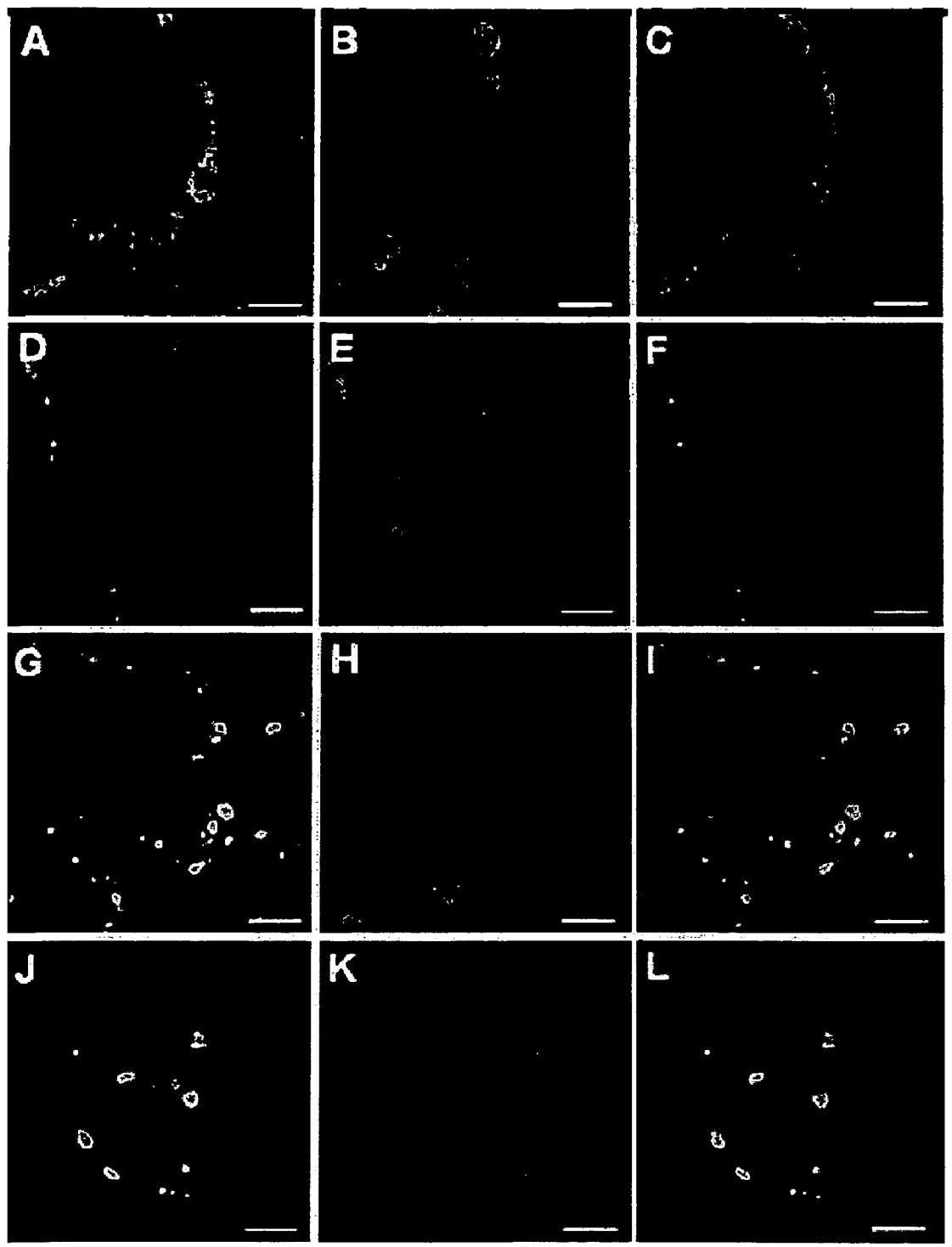
FIG. 44. Confocal micrographs of Apo AI-GFP constitutive constructs expressed in leaf epidermal cells. (A-C) Apo17 is untargeted mature Apo AI fused to GFP. (D-F) Apo18 is untargeted pro-Apo AI fused to GFP. (G-H) Apo19 is mature Apo AI fused to GFP targeted to the secretory pathway. (J-L) Apo20 is pro-Apo AI fused to GFP targeted to the secretory pathway. (Column 1) Green channel. (Column 2) Red channel. (Column 3) Merged channels. Bar=5 μm.

The resulting micrographs can be seen in FIGS. 42 to 45. Colocalization (indicated in yellow) between untargeted pro-Apo AI-GFP fusions (Apo11) and Nile red stained oil bodies, is evident in FIG. 41 (D-F). There is also colocalization (indicated in yellow) between Apo12, mature Apo AI fused to GFP targeted to oil bodies using oleosin, (G-I of FIG. 41) and Apo13, pro-Apo AI fused to GFP targeted to oil bodies using oleosin (A-C of FIG. 42). Colocalization (indicated in yellow) between untargeted pro-Apo AI-GFP fusions (Apo18) and Nile red stained oil bodies is evident in (D-F of FIG. 43). No colocalization between Apo AI-GFP fusion protein (Apo19) and oil bodies is observed (G-H of FIG. 43). In FIG. 44, no colocalization is evident in the leaves. In conclusion, in the absence of an oil body target (i.e. oleosin), co-localization of Apo AI is observed only in the embryos (in the presence of neutral lipid) and only when the pro-peptide of Apo AI is expressed in the cytoplasm (i.e. not when secreted).

Example 6

Cleavage and HPLC Analysis of Apo 25, 26 and 28 Expressing *Arabidopsis* Seed

Cleavage of Apo25, Apo26 and Apo28 Recombinant Protein

The isolation of oil bodies was performed as previously described (van Rooijen & Moloney, 1995) with the following modifications. Briefly, 250 mg of dry mature seeds were surface sterilized with 70% ethanol, rinsed twice with sterile water and once with a phosphate buffer (100 mM phosphate buffer pH 8 with 0.5M NaCl). After washing, the seeds were resuspended in phosphate buffer for analytical analysis and then ground using a sterilized mortar and pestle. After grinding, the sample was transferred to a centrifuge bottle and centrifuged for 15 min at 10,000 g at RT. After centrifugation, the fat pad containing the oil bodies was transferred to a 1.5 mL microfuge tube and resuspended in a urea buffer (8M Urea in 100 mM Na-Carbonate buffer pH 8). The sample was centrifuged for 15 min at 10,000 g at 4° C. and the undernatant removed. The fat pad was resuspended in sterile ddH$_2$O, centrifuged for 15 min at 10,000 g at 4° C. and the undernatant removed. The oil bodies were resuspended in 50 μL of sterile ddH$_2$O and stored in the dark at 4° C. The cleavage reaction was performed in a 20 μL reaction volume containing 100 mM phosphate buffer pH 4.5, with a final ratio of 1:100 protease to oil body protein, at 37° C. for 2 hrs. A sample reaction would be as follows: 20 μg of purified Apo25, Apo26 or Apo28 was combined with 2 μL 1M phosphate buffer pH 4.5 (final concentration 100 mM), 2 μL chymosin (0.1 _g/_) with sterile ddH$_2$O to bring up to final volume of 20 μL. After 2 hrs, the cleavage reaction was centrifuged for 15 min, and the undernatant was removed from the fat pad and each phase was analyzed for recombinant protein.

Purification of Apo25, Apo26 and Apo28 by Reverse Phase Chromatography

Approximately, 1000 μg of Apo25, Apo26 or Apo28 was cleaved by chymosin for 2 hrs at 37° C. After the cleavage reaction was completed, the reaction was centrifuged for 15 min at 10,000 g at 4° C. and the undernatent was recovered. The fat pad was resuspended in a urea buffer (8M Urea in 0.1 mM Na-Carbonate buffer pH 8), and recentrifuged for 15 min. The undernatent or wash was recovered, and the washes were repeated for an additional three times, with the undernatent being recovered each time and pooled into a 15 mL Falcon tube. After the urea washes were completed, the washes were aliquoted into 1.5 mL microfuge tubes, and centrifuged for 15 minutes to remove any contaminating oil body residue. The undernatents were recovered and filtered into a new 15 mL Falcon tube using a 0.2 micron filter. A VYDAC 214TP54 C4 silica 5 micron (Grace Vydac, Anaheim, Calif.) reverse-phase chromatography column (0.24× 25 cm) was equilibrated in buffer A (10% acetonitrile and 0.1% trifluoroacetic acid) at a flow-rate of 2 mL/min. The pooled chymosin-cleaved Apo25, Apo26 or Apo28 urea undernatent was loaded on the column. A linear gradient was applied to the column 0 to 60% buffer B (95% acetonitrile, 0.1% trifluoroacetic acid) for the elution of Apo AI. Apo AI (US Biological, Catalogue number A2299-10) was used as a standard for comparising the cleavage products from Apo25, Apo26 and Apo28. Fractions 19.6' to 20.8' (0.2'=0.4 mL each) were collected. Comparing the relative intensities of the DAD traces at 214, 254, 280 & 326 nm indicates that the material eluting in the 19.5-21.0' zone most likely represents the Apo AI polypeptide (FIG. 45A). These peaks also increased in intensity compared to a previous injection of 0.020 mL of the same sample. To purify the cleavage product from Apo25 (oleosin-klip8-Apo AI(met+)), chymosin treated fractions were collected from 7 to 25' @ 1 mL each. The major polypeptide peak is at 20.5' (FIG. 45B), which is just 0.2' later than the suspected hApo AI standard. To purify the cleavage product from Apo26 (oleosin-klip8-pro-Apo AI(met+)), fractions were collected from 7 to 25' at 1 mL each. The major polypeptide peak is at 18' (FIG. 45C), which is 2.4° earlier than the suspected hApo AI standard. To purify the cleavage product from Apo28 (oleosin-klip8-pro-Apo AI), fractions were collected from 7 to 25° at 1 mL each. The major polypeptide peak is at 18' (FIG. 45D), which is 2.4° earlier than the suspected hApo AI standard but similar to the Apo26 run.

Mass Spectrometry

Mass spectra were acquired by Doug Olson (National Research Council of Canada, Plant Biotechnology Institute BioAnalytical Spectroscopy Group, Saskatoon, SK) on an Applied Biosystems Voyager-DE STR matrix assisted laser desorption ionisation time of flight (MALDI-TOF) mass spectrometer instrument (Applied Biosystems, Foster City, Calif.). Samples were spotted onto a OPI-TOF LC MALDI insert (Applied Biosystems, Foster City, Calif.) using a matrix of sinapinic acid saturated in 30% acetonitrile/70% water/0.1% TFA. Ions were accelerated at +20 kV and masses were detected in linear mode, with horse heart myoglobin used as an external calibrant.—Electrospray ionization mass spectrometry of the purified recombinant mature Apo25 protein gave a molecular mass of 28, 325 Da, which is 6 Da greater than calculated molecular weight of 28, 319 Da. The difference in value from the observed value from the expected, may be due to a case of limited sample leading to a decreased signal to noise ratio and a decreased accuracy. The expected molecular weight of mature Apo AI is 28, 187 Da, but due to the presence of the additional Met residue, the cleaved recombinant mature Apo AI protein has an increased molecular weight. The purified standard hApo AI protein was also analyzed by mass spectrometry, and it possessed two distinct peaks at 25, 969 Da and 22, 815 Da. Both of these observed values are significantly lower than the expected value of 28, 187 Da; however, these two predominant lower molecular weights were previously observed on the immunoblots. It is likely that it is this decrease in molecular weight that results in the slightly different elution profile of the human and recombinant proteins as was seen by RP-HPLC.

Example 7

Transformation of Safflower

This transformation protocol is similar to that outlined by Orlilcowska T. K. et al. ((1995) Plant Cell, Tissue and Organ Culture 40: 85-91), but with modifications and improvements both for transforming S-317 and for using phosphinothricin as the selectable marker. Decontaminate seeds from S-317 California variety of safflower, which are not damaged, cracked or diseased, in 0.1% $HCl_2$ for 12 minutes followed by 4-5 rinses with sterile distilled water. Germinate sterile seeds in the dark on MS medium (Murashige T. & Skoog F (1962) Physiol. Plant. 15: 473-497) with 1% sucrose and 0.25% Gelrite. Initiate *Agrobacterium* cultures from frozen glycerol stocks in 5 ml AB minimal liquid media with antibiotic selection, and grow for 48 hours at 28° C. Grow an aliquot of this culture grown overnight in 5 ml of Luria broth with selection for transformation. Wash 6-8 ml of bacterial cells twice with AB media, and make up to a final cell density of 0.4-0.5 (OD600).

Remove two-day-old cotyledons from germinated seedlings, dip in the prepared *Agrobacterium* cells, and plate on MS medium with 3% sucrose, 4 µM N6-benzyladenine (BA) and 0.8 µM naphthaleneacetic acid (NAA). Incubate plates at 21° C. under dark conditions. After 3 days, transfer to the same medium with 300 mg/L timentin. After an additional 4 days, move all cultures to the light. After 3 days, place explants on selection medium with phosphinothricin added at 0.5 mg/L. For continued bud elongation, transfer explants weekly onto MS medium without phytohormones but with twice the basal amount of $KNO_3$. Excise shoots that had elongated to greater than 10 mm from the initial explant and individually grow on selection. For rooting, place green shoots, representing putative transgenic tissue, on MS medium with 2% sucrose, 10 µM indolebutyric acid and 0.5 µM NAA. Transfer rooted shoots to a well drained soil-less mix and grow under high humidity and 12 hours of light.

Example 8

Flax Transformation Protocol

This transformation procedure is similar to that outlined by Dong J. and McHughen A. (Plant Cell Reports (1991) 10: 555-560), Dong J. and McHughen A. (Plant Sciences (1993) 88: 61-71) and Mlynarova et al. (Plant Cell Reports (1994) 13: 282-285). Decontaminate flax seeds, which are not damaged, cracked or diseased, in a 70% ethanol solution for 5 to 7 minutes, followed by 25 minutes in a 50% bleach solution with Tween 20 (3-4 drops per 100 ml) with continuous stirring. Rinse seeds 5 to 7 times with sterile distilled water. Germinate decontaminated seeds in the light on MS medium (Murashige T. & Skoog F (1962) Physiol. Plant. 15: 473-497) with 2% sucrose and 0.3% Gelrite® in Magenta jars. For transformation, grow *Agrobacterium* cultures overnight in AB broth plus the appropriate antibiotic for selection. Wash 6 to 8 ml of overnight cells twice, and re-suspended in 5 ml of AB broth; add 2 ml of this stock to 98 ml of induction medium (MS basal medium with 3% sucrose, 5 µM 6-benzylaminopurine (BA) and 0.25 μM alpha-naphthalene acetic acid (NAA) and adjust for a final $OD_{600}$ of 1.0.

Section hypocotyl explants, and inoculate in the prepared *Agrobacterium* cell solution for about 4 h (stir plates gently 1-2 times during this period). After the infection period, remove explants from the liquid inoculation medium and blot on sterile filter paper. Plate 15-20 explants on 0.7% agar-solidified induction medium in tissue culture plates. Seal the plates with plastic wrap, and co-cultivate explants for 48 h under light conditions (23-24° C.). After 2 days, transfer the green, meristematic explants to the same medium containing 300 mg/L Timentin (pre-selection media) and wrap with plastic wrap. After 3 days, transfer the cultures to the above medium containing 10 mg/L DL PPT (Selection 1). Wrap the plates with Parafilm® and incubate at 24° C. under light conditions. Transfer cultures every two weeks and keep on this media for one month. For shoot elongation, transfer the cultures every two weeks on selection medium II (MS basal medium containing 2% sucrose, 500 mg/L MES buffer, 300 mg/L Timentin and 10 mg/L DL PPT) in Magenta jars. Putative transformed shoots, which survived selection, are dark green and form vigorous roots in 7-10 days when planted individually on selection II media. Transfer rooted shoots to sterilized greenhouse soil mix in small pots and cover plantlets with clear plastic cups for acclimatization. For maturation, transfer actively growing plants to one-gallon pots with a well-drained soil mix and grow under greenhouse conditions.

While the present invention has been described with reference to what are presently considered to be the preferred examples, it is to be understood that the invention is not limited to the disclosed examples. To the contrary, the invention is intended to cover various modifications and equivalent arrangements included within the spirit and scope of the appended claims.

All publications, patents and patent applications are herein incorporated by reference in their entirety to the same extent as if each individual publication, patent or patent application was specifically and individually indicated to be incorporated by reference in its entirety.

Summary of Sequences

SEQ ID NO:1 and 2 set forth the nucleotide sequence and the deduced amino acid sequence, respectively, of the human pro-Apo AI protein.

SEQ ID NO:3 and 4 set forth the nucleotide sequence and the deduced amino acid sequence, respectively, of the human Apo AI Milano protein.

SEQ ID NO:5 and 6 set forth the nucleotide sequence and the deduced amino acid sequence, respectively, of the human Apo AI Paris protein.

SEQ ID NO:1, 7 and 8 are known human Apolipoprotein sequences which are described in Table 1.

SEQ ID NO:9-24 are known Apolipoprotein A-I sequences which are described in Table 1.

SEQ ID NO:25-34 are known Apolipoprotein A-IV sequences which are described in Table 1.

SEQ ID NO:35-55 are known Apolipoprotein E sequences which are described in Table 1.

SEQ ID NO:56 sets forth the nucleic acid sequence of an *Arabidopsis thaliana* thioredoxin SEQ ID NO:57 sets forth the nucleic acid sequence of a soluble green fluorescent protein SEQ ID NO:58 sets forth the amino acid sequence of a PRS signal sequence.

SEQ ID NO:59-116 are known oleosin oil body protein sequences which are described in Table 3.

SEQ ID NO:117-129 are known caleosin oil body protein sequences which are described in Table 3.

SEQ ID NO:130-137 are known steroleosin oil body protein sequences which are described in Table 3.

SEQ ID NO:138 sets forth a known *Arabidopsis thaliana* oleosin oil body protein sequence.

SEQ ID NO:139 sets forth a known *Brassica napus* oleosin oil body protein sequence.

SEQ ID NO:140 sets forth a known *Arabidopsis thaliana* caleosin oil body protein nucleic acid sequence.

SEQ ID NO:141 sets forth a known *Arabidopsis thaliana* caleosin oil body protein nucleic acid sequence.

SEQ ID NO:142 sets forth a known stereoleosin oil body protein nucleic acid sequence.

SEQ ID NO:143 sets forth the nucleotide sequence for the klip8 cleavage sequence.

SEQ ID NO:144 and 145 set forth the nucleotide sequence and the deduced amino acid sequence, respectively, of the Apo10 clone.

SEQ ID NO:146 sets forth the nucleotide sequence of the forward primer 1186 which is complementary to the 5' region of GFP and is designed to remove the NcoI site.

SEQ ID NO:147 sets forth the nucleotide sequence of the reverse primer 1187 which is complementary to the 3' region of GFP and is designed to add PstI, XbaI and HindIII sites after the stop codon.

SEQ ID NO:148 sets forth the nucleotide sequence of the forward primer 1190 which is complementary to the 5' region of mature Apo AI and is designed to add a NcoI site to the start of the gene.

SEQ ID NO:149 sets forth the nucleotide sequence of the reverse primer 1189 which is complementary to the 5' region of mature Apo AI and is designed to remove the stop codon of the gene and add a BamHI site to assist in creating an in-frame translational fusion with GFP.

SEQ ID NO:150 and 151 set forth the nucleotide and deduced amino acid sequences, respectively, of the Apo11 clone.

SEQ ID NO:152 sets forth the nucleotide sequence of the forward primer 1191 which is complementary to the 5' region of pro-Apo AI and is designed to add a NcoI site to the start of the gene.

SEQ ID NO:153 and 154 set forth the nucleotide and deduced amino acid sequences, respectively, of the Apo12 clone.

SEQ ID NO:155 and 156 set forth the nucleotide and deduced amino acid sequences, respectively, of the Apo13 clone.

SEQ ID NO:157 and 158 set forth the nucleotide and deduced amino acid sequences, respectively, of the Apo15 clone.

SEQ ID NO:159 and 160 set forth the nucleotide and deduced amino acid sequences, respectively, of the Apo16 clone.

SEQ ID NO:161 and 162 set forth the nucleotide and deduced amino acid sequences, respectively, of the Apo17 clone.

SEQ ID NO:163 and 164 set forth the nucleotide and deduced amino acid sequences, respectively, of the Apo18 clone.

SEQ ID NO:165 and 166 set forth the nucleotide and deduced amino acid sequences, respectively, of the Apo19 clone.

SEQ ID NO:167 sets forth the nucleotide sequence for forward primer 1177 which is complementary to the 5' region of PRS/Apo AI (clone Apo15) and is designed to amplify the start of the plant presequence (PRS) which contains a BspHI site at the start codon.

SEQ ID NO:168 sets forth the nucleotide sequence for reverse primer 1178 which is complementary to the 3' region of Apo AI and is designed to remove the stop codon of the gene and add a BamHI site to assist in creating an in-frame translational fusion with GFP.

SEQ ID NO:169 and 170 set forth the nucleotide and deduced amino acid sequences, respectively, of the Apo20 clone.

SEQ ID NO:171 and 172 set forth the nucleotide and deduced amino acid sequences, respectively, of the Apo21 clone.

SEQ ID NO:173 sets forth the nucleotide sequence of forward primer 1203 which is complementary to the 5' region of Apo AI and is designed to add a NcoI site to the start of mature Apo AI.

SEQ ID NO:174 sets forth the nucleotide sequence of reverse primer 1206 which is complementary to the 3' region of Apo AI and is designed to add a HindIII site after the stop codon.

SEQ ID NO:175 and 176 set forth the nucleotide and deduced amino acid sequences, respectively, of the Apo22 clone.

SEQ ID NO:177 sets forth the nucleotide sequence of forward primer 1201 which is complementary to the 5' region of pro AI and is designed to add an NcoI site to the start of pro-Apo AI.

SEQ ID NO:178 and 179 set forth the nucleotide and deduced amino acid sequences, respectively, of the Apo23 clone.

SEQ ID NO:180 and 181 set forth the nucleotide and deduced amino acid sequences, respectively, of the Apo24 clone.

SEQ ID NO:182 and 183 set forth the nucleotide and deduced amino acid sequences, respectively, of the Apo25 clone.

SEQ ID NO:184 and 185 set forth the nucleotide and deduced amino acid sequences, respectively, of the Apo26 clone.

SEQ ID NO:186 and 187 set forth the nucleotide and deduced amino acid sequences, respectively, of the Apo27 clone.

SEQ ID NO:188 sets forth the nucleotide sequence of forward primer 1200 which is complementary to the 5' region of mature Apo AI and is design to add an XhoI site and extra nucleotides to facilitate in-frame cloning into the klip8 cleavage sequence to the start of pro-Apo AI.

SEQ ID NO:189 and 190 set forth the nucleotide and deduced amino acid sequences, respectively, of the Apo27M clone.

SEQ ID NO:191 sets forth the nucleotide sequence of forward primer 1202 which is complementary to the 5' region of the human Apo AI and is designed to amplify the human Apo AI sequence, add a XhoI site and extra nucleotides to facilitate in-frame cloning into the klip8 cleavage sequence to the start of mat-Apo AI.

SEQ ID NO:192 sets forth the nucleotide sequence of forward primer 1225 is a blunt ended primer which makes a base pair mutation from C to T to change an Arg residue into a Cys residue thereby creating the Apo-Milano mutation.

SEQ ID NO:193 and 194 set forth the nucleotide and deduced amino acid sequences, respectively, of the Apo28 clone.

SEQ ID NO:195 sets forth the nucleotide sequence of forward primer 1205 which is complementary to the 5' region of pro-Apo AII and is designed to be a blunt ended primer which adds a silent mutation to remove the first XhoI site.

SEQ ID NO:196 and 197 set forth the nucleotide and deduced amino acid sequences, respectively, of the Apo29 clone.

SEQ ID NO:198 and 199 set forth the nucleotide and deduced amino acid sequences, respectively, of the Apo30 clone.

SEQ ID NO:200 and 201 set forth the nucleotide and deduced amino acid sequences, respectively, of the Apo31 clone.

SEQ ID NO:202 and 203 set forth the nucleotide and deduced amino acid sequences, respectively, of the Apo32 clone.

SEQ ID NO:204 and 205 set forth the nucleotide and deduced amino acid sequences, respectively, of the Apo33 clone.

SEQ ID NO:206 and 207 set forth the nucleotide and deduced amino acid sequences, respectively, of the Apo34 clone.

SEQ ID NO:208 and 209 set forth the nucleotide and deduced amino acid sequences, respectively, of the Apo35 clone.

SEQ ID NO:210 sets forth the nucleotide sequence of reverse primer 1208 which is complementary to the 3' region of pro-Apo AI and is designed to add a KDEL sequence before the stop codon and a HindIII site after the stop codon.

SEQ ID NO:211 and 212 set forth the nucleotide and deduced amino acid sequences, respectively, of the Apo36 clone.

SEQ ID NO:213 and 214 set forth the nucleotide and deduced amino acid sequences, respectively, of the Apo37 clone.

SEQ ID NO:215 and 216 set forth the nucleotide and deduced amino acid sequences, respectively, of the Apo38 clone.

SEQ ID NO:217 and 218 set forth the nucleotide and deduced amino acid sequences, respectively, of the Apo39 clone.

SEQ ID NO:219 sets forth the nucleotide sequence of forward primer 1207 which is complementary to the 5' region of the klip8 cleavage sequence and is designed to amplifies the start of the klip8 sequence and adds a SalI site to the start codon.

SEQ ID NO:220 and 221 set forth the nucleotide and deduced amino acid sequences, respectively, of the Apo40 clone.

SEQ ID NO:222 and 223 set forth the nucleotide and deduced amino acid sequences, respectively, of the Apo41 clone.

SEQ ID NO:224 and 225 set forth the nucleotide and deduced amino acid sequences, respectively, of the Apo42 clone.

SEQ ID NO:226 and 227 set forth the nucleotide and deduced amino acid sequences, respectively, of the Apo43 clone.

SEQ ID NO:228 and 229 set forth the nucleotide and deduced amino acid sequences, respectively, of the Apo44 clone.

SEQ ID NO:230 and 231 set forth the nucleotide and deduced amino acid sequences, respectively, of the Apo45 clone.

SEQ ID NO:232 and 233 set forth the nucleotide and deduced amino acid sequences, respectively, of the Apo46 clone.

SEQ ID NO:234 and 235 set forth the nucleotide and deduced amino acid sequences, respectively, of the Apo47 clone.

SEQ ID NO:236 sets forth the nucleotide sequence of forward primer 1226 which is complementary to the 5' region of the maize oleosin sequence and is designed to amplifies the maize oleosin sequence and adds a NcoI site to the start codon.

SEQ ID NO:237 sets forth the nucleotide sequence of forward primer 1227 which is complementary to the 3' region of the maize oleosin sequence and is designed to amplify the maize oleosin, remove the stop codon of the gene and add a HindIII site to assist in creating an in-frame translational fusion with klip8/matApo AI.

SEQ ID NO:238 sets forth the nucleotide sequence of forward primer 1228 which is complementary to the 5' region of the Apo25 clone and is designed to amplify the Apo25 sequence and adds a SalI site to the start codon.

SEQ ID NO:239 sets forth the nucleotide sequence of reverse primer 1229 which is complementary to the 3' region of the Apo25 clone and is designed to amplify the Apo25 sequence and adds a BamHI site after the stop codon.

SEQ ID NO:240 sets forth the amino acid sequence of the single chain antibody D9scFv.

SEQ ID NOS. 241-251 are known Apolipoprotein AV sequences which are described in Table 1.

TABLE 1

Examples of known Apolipoprotein sequences

| SEQUENCE ID. NO. | APOLIPOPROTEIN SOURCE (Accession number) |
|---|---|
| *Apolipoprotein A-I* | |
| 1 | Human (NM 000039, BC005380, J00098, M11791, M27875, M29068, X00566, X01038, X02162, X07496) |
| 9 | *Danio rerio* (NP_571203) |
| 10 | *Rattus norvegicus* (P04639) |
| 11 | *Bos taurus* (P15497) |
| 12 | *Mus musculus* (Q00623) |
| 13 | *Ovis aries* (AAB57840) |
| 14 | *Sus scrofa* (P18648) |
| 15 | *Cyprinus carpio* (CAC34942) |
| 16 | *Gallus gallus* (AAA48593) |
| 17 | *Oryctolagus cuniculus* (P09809) |
| 18 | *Macaca fascicularis* (P15568) |
| 19 | *Coturnix japonica* (P32918) |
| 20 | *Canis familiaris* (P02648) |
| 21 | *Tupaia belangeri* (O18759) |
| 22 | *Anas platyrhynchos* (O42296) |
| 23 | *Papio anubis* (AAA35380) |
| 24 | *Macaca mulatto* (P14417) |
| *Apolipoprotein A-IV* | |
| 7 | Human (NM 0000482, J02758, M10373, M13654, M14566, M14642, X13629, P0672) |
| 25 | *Rattus norvegicus* (AAA85909) |
| 26 | *Mus musculus* (P06728) |
| 27 | *Mus musculus castaneus* (AAA37216) |
| 28 | *Sus scrofa* (O46409) |
| 29 | *Papio anubis* (Q28758) |
| 30 | *Macaca fascicularis* (P33621) |
| 31 | *Pan troglodytes* (I54248) |
| 32 | *Papio sp.* (A47141) |
| 33 | *Gillichthys mirabilis* (AAG13299) |
| 34 | *Oryctolagus cuniculus* (AAB34783) |
| *Apolipoprotein A-V* | |
| 241 | *Mus musculus* (NM_080434) |
| 242 | *Rattus norvegicus* (NM_080576) |
| 243 | *Homo sapiens* (NP_443200) |
| 244 | *Mus musculus* (BC011198) |
| 245 | *Homo sapiens* (AY555191) |
| 246 | *Homo sapiens* (AY422949) |
| 247 | *Mus musculus* (AF327059) |
| 248 | *Homo sapiens* (AF202890) |
| 249 | *Homo sapiens* (AF202889) |
| 250 | *Rattus norvegicus* (AF202888) |
| 251 | *Rattus norvegicus* (AF202887) |
| *Apolipoprotein E* | |
| 8 | Human (NM 000041, AF050154, AF261279, BC003557, K00396, M10065, M12529, X00199, X92000, Z70760) |
| 35 | *Rattus norvegicus* (P02650) |
| 36 | *Danio rerio* (O42364) |
| 37 | *Bos Taurus* (Q03247) |
| 38 | *Mus musculus* (P08226) |
| 39 | *Cards familiaris* (P18649) |
| 40 | *Saimiri sciureus* (Q28995) |
| 41 | *Macaca mulatto* (Q28502) |
| 42 | *Sus scrofa* (P18650) |
| 43 | *Oryctolagus cuniculus* (P18287) |
| 44 | *Papio anubis* (P05770) |
| 45 | *Macaca fascicularis* (P10517) |
| 46 | *Cavia porcellus* (P23529) |
| 47 | *Zalophus californianus* (JC5566) |
| 48 | *Ovis sp.* (JC6549) |
| 49 | *Pongo pygmaeus* (AAG28580) |
| 50 | *Hylobates lar* (AAG28581) |
| 51 | *Gorilla gorilla* (AAG28579) |
| 52 | *Pan troglodytes* (AAG28578) |
| 53 | *Tupaia glis* (AAG21401) |
| 54 | *Oncorhynchus mykiss* (CAB65320) |
| 55 | *Scophthalmus maximus* (CAB65356) |

TABLE 2

Examples of known apolipoprotein mutations and modifications

| Protein | Mutation | Reference |
|---|---|---|
| POINT MUTATIONS | | |
| Apo AI | Glu198Lys | Strobl W et al., Pediatr Res. 1988 Aug; 24(2): 222-8 |
| Apo AI | Gly26Arg | Vigushin D M et al. QJ Med. 1994 Mar; 87(3): 149-54 |
| Apo AI | Leu60Arg | Soutar A K et al. Proc Natl Acad Sci USA. 1992 Aug 15; 89(16): 7389-93 |
| Apo AI | Val156Glu | Cho K H and Jonas A. J Biol Chem. 2000 Sep 1; 275(35): 26821-7 |

TABLE 2-continued

Examples of known apolipoprotein mutations and modifications

| Protein | Mutation | Reference |
| --- | --- | --- |
| Apo AI Baltimore | Arg10Leu | Ladias J A et al., Hum Genet. 1990 Apr; 84(5): 439-45 |
| Apo AI Giessen | Pro143Arg | Utermann G et al., Eur J Biochem. 1984 Oct 15; 144(2): 325-31 |
| Apo AI Fukuoka | Glu110Lys | Takada Y et al., Biochim Biophys Acta. 1990 Apr 2; 1043(2): 169-76. |
| Apo AI Fin | Arg159Leu | Miettinen H E et al. Arterioscler Thromb Vasc Biol. 1997 Jan; 17(1): 83-90 |
| Apo AI Milano | Arg173Cys | Cheung M C et al., Biochim Biophys Acta. 1988 May 2; 960(1): 73-82 |
| Apo AI Paris | Arg151Cys | Bruckert E et al., Atherosclerosis. 1997 Jan 3; 128(1): 121-8 |
| Apo AV | Val153Met Cys185Gly | Hubacek et al. Physiol. Res. 2004. 53: 225-228 |
| Apo AV | Thr131Cys Ser19Trp | Hubacek et al. Clin. Genet. 2004. 65: 126-130 |
| Apo E | Arg136Cys | Hubacek J A et al. Physiol Res. 2002; 51(1): 107-8 |
| Apo E*5 | Gln204Lys, Cys112Arg, or Glu212Lys | Scacchi R. et al. Hum Biol. 2003 Apr; 75(2): 293-300; Feussner et al., J Lipid Res. 1996 Aug; 37(8): 1632-45 |
| Apo E1 | Lys146Glu | Mann W A et al., J Clin Invest. 1995 Aug; 96(2): 1100-7 |
| Apo E2 | Arg136Cys | Feussner G. et al. Eur J Clin Invest. 1996 Jan; 26(1): 13-23 |
| Apo E2 | Arg142Leu | Richard P et al. Atherosclerosis. 1995 Jan 6; 112(1): 19-28 |
| Apo E2 | Arg25Cys | Matsunaga et al. Kidney Int. 1999 Aug; 56(2): 421-7 |
| Apo E2 | Lys146Gln | Smit M et al., J Lipid Res. 1990 Jan; 31(1): 45-53 |
| Apo E2 Christchurch | Arg136Ser | Wardell M R et al. J Clin Invest. 1987 Aug; 80(2): 483-90. |
| Apo E3 | Arg136Cys | Walden C C et al. J Clin Endocrinol Metab. 1994 Mar; 78(3): 699-704 |
| Apo E3 | Arg136His | Minnich A et al. J Lipid Res. 1995 Jan; 36(1): 57-66. |
| Apo E5-Frankfurt | Gln81Lys, Cys112Arg | Ruzicka V et al. Electrophoresis. 1993 Oct; 14(10): 1032-7 |
| DELETION MUTATIONS | | |
| Apo AI nichinan | Glu235 deletion | Han et al. Arterioscler Thromb Vasc Biol. 1999 Jun; 19(6): 1447-55 |
| Apo AI | Lys 107 deletion | Amarzguioui M et el. Biochem Biophys Res Commun. 1998 Jan 26; 242(3): 534-9 |
| FRAMESHIFT MUTATIONS | | |
| Apo AI Sasebo | partial gene duplication, tandem repeat of bases 333 to 355 from the 5' end of exon 4 resulting with premature termination after amino acid 207 | Moriyama K et al. Arterioscler Thromb Vasc Biol. 1996 Dec; 16(12): 1416-23 |
| CHEMICAL MODIFICATIONS | | |
| Apo AI | sulfoxidized Met-112 and Met-148 residues and the corresponding reduced form | Jonas A et al. Biochim Biophys Acta. 1993 Feb 24; 1166(2-3): 202-10 |

TABLE 3

Examples of known oil body protein sequences

SEQ. ID NO. | Oil Body Protein Motif (Amino Acid Sequence Identifier) {Nucleic Acid Sequence Identifier}

Oleosin

| SEQ ID | Description |
|---|---|
| 59 | (A84654) *Arabidopsis thaliana* probable oleosin |
| 60 | (AAA87295) *Arabidopsis thaliana* oleosin {Gene L40954} |
| 61 | (AAC42242) *Arabidopsis thaliana* oleosin {Gene AC005395} |
| 62 | (AAF01542) *Arabidopsis thaliana* putative oleosin {Gene AC009325} |
| 63 | (AAF69712) *Arabidopsis thaliana* F27J15.22 {Gene AC016041} |
| 64 | (AAK96731) *Arabidopsis thaliana* oleosin-like protein {Gene AY054540} |
| 65 | (AAL14385) *Arabidopsis thaliana* AT5g40420/MPO12_130 oleosin isoform {Gene AY057590} |
| 66 | (AAL24418) *Arabidopsis thaliana* putative oleosin {Gene AY059936} |
| 67 | (AAL47366) *Arabidopsis thaliana* oleosin-like protein {Gene AY064657} |
| 68 | (AAM10217) *Arabidopsis thaliana* putative oleosin {Gene AY081655} |
| 69 | (AAM47319) *Arabidopsis thaliana* AT5g40420/MPO12_130 oleosin isoform {Gene AY113011} |
| 70 | (AAM63098) *Arabidopsis thaliana* oleosin isoform {Gene AY085886} |
| 71 | (AAO22633) *Arabidopsis thaliana* putative oleosin {Gene BT002813} |
| 72 | (AAO22794) *Arabidopsis thaliana* putative oleosin protein {Gene BT002985} |
| 73 | (AAO42120) *Arabidopsis thaliana* putative oleosin {Gene BT004094} |
| 74 | (AAO50491) *Arabidopsis thaliana* putative oleosin {Gene BT004958} |
| 75 | (AAO63989) *Arabidopsis thaliana* putative oleosin {Gene BT005569} |
| 76 | (AAQ56108) *Arabidopsis lyrata* subsp. *Lyrata* Oleosin. {Gene AY292860} |
| 77 | (BAA97384) *Arabidopsis thaliana* oleosin-like {Gene AB023044} |
| 78 | (BAB02690) *Arabidopsis thaliana* oleosin-like protein {Gene AB018114} |
| 79 | (BAB11599) *Arabidopsis thaliana* oleosin, isoform 21K {Gene AB006702} |
| 80 | (BAC42839) *Arabidopsis thaliana* putative oleosin protein {Gene AK118217} |
| 81 | (CAA44225) *Arabidopsis thaliana* oleosin {Gene X62353} |
| 82 | (CAA63011) *Arabidopsis thaliana* oleosin, type 4 {Gene X91918} |
| 83 | (CAA63022) *Arabidopsis thaliana* oleosin, type 2 {Gene X91956} |
| 84 | (CAA90877) *Arabidopsis thaliana* oleosin {Gene Z54164} |
| 85 | (CAA90878) *Arabidopsis thaliana* oleosin {Gene Z54165} |
| 86 | (CAB36756) *Arabidopsis thaliana* oleosin, 18.5 K {Gene AL035523} |
| 87 | (CAB79423) *Arabidopsis thaliana* oleosin, 18.5 K {Gene AL161562} |
| 88 | (CAB87945) *Arabidopsis thaliana* oleosin-like protein {Gene AL163912} |
| 89 | (P29525) *Arabidopsis thaliana* oleosin 18.5 kDa {Gene X62353, CAA44225, AL035523, CAB36756, CAB36756, CAB79423, Z17738, S22538} |
| 90 | (Q39165) *Arabidopsis thaliana* Oleosin 21.2 kDa (Oleosin type 2). {Gene L40954, AAA87295, X91956, CAA63022, Z17657, AB006702, BAB11599, AY057590, AAL14385, S71253 |
| 91 | (Q42431) *Arabidopsis thaliana* Oleosin 20.3 kDa (Oleosin type 4) {Gene Z54164, CAA90877, X91918, CAA63011, AB018114, BAB02690, AY054540, AAK96731, AY064657, AAL47366, AY085886, AAM63098, Z27260, Z29859, S71286 |
| 92 | (Q43284) *Arabidopsis thaliana* Oleosin 14.9 kDa. {Gene Z54165, CAA90878, AB023044, BAA97384, Z27008, CAA81561} |
| 93 | (S22538) *Arabidopsis thaliana* oleosin, 18.5 K |
| 94 | (S71253) *Arabidopsis thaliana* oleosin, 21 K |
| 95 | (S71286) *Arabidopsis thaliana* oleosin, 20 K |
| 96 | (T49895) *Arabidopsis thaliana* oleosin-like protein |
| 97 | (AAB22218) *Brassica napus* oleosin napII |
| 98 | (AAD24547) *Brassica oleracea* oleosin |
| 99 | (CAA43941) *Brassica napus* oleosin BN-III {Gene X63779} |
| 100 | (CAA45313) *Brassica napus* oleosin BN-V {Gene X63779} |
| 101 | (P29109) *Brassica napus* Oleosin Bn-V (BnV) {Gene X63779, CAA45313, S25089) |
| 102 | (P29110) *Brassica napus* Oleosin Bn-III (BnIII) {Gene X61937, CAA43941, S22475) |
| 103 | (P29111) *Brassica napus* Major oleosin NAP-II {Gene X58000, CAA41064, S70915) |
| 104 | (S22475) *Brassica napus* oleosin BN-III |
| 105 | (S50195) *Brassica napus* Oleosin |
| 106 | (T08134) *Brassica napus* Oleosin-like |
| 107 | (AAB01098) *Daucus carota* oleosin |
| 108 | (T14307) carrot oleosin |
| 109 | (A35040) *Zea mays* oleosin 18 |
| 110 | (AAA67699)*Zea mays* oleosin KD18 {Gene J05212} |
| 111 | (AAA68065) *Zea mays* 16 kDa oleosin {Gene U13701} |
| 112 | (AAA68066) *Zea mays* 17 kDa oleosin {Gene U13702} |
| 113 | (P13436) *Zea mays* OLEOSIN ZM-I (OLEOSIN 16 KD) (LIPID BODY-ASSOCIATED MAJOR PROTEIN) {Gene U13701, AAA68065, M17225, AAA33481, A29788} |
| 114 | (P21641) *Zea mays* Oleosin Zm-II (Oleosin 18 kDa) (Lipid body-associated protein L2) {Gene J05212, AAA67699, A35040} |
| 115 | (S52029) *Zea mays* oleosin 16 |
| 116 | (S52030) *Zea mays* oleosin 17 |

Caleosin

| SEQ ID | Description |
|---|---|
| 117 | (XP_467656) putative caleosin [*Oryza sativa* (*japonica* cultivar-group)]. |
| 118 | (BAD16161) putative caleosin [*Oryza sativa* (*japonica* cultivar-group)]. {Gene AP005319} |
| 119 | (NP_973892) caleosin-related family protein [*Arabidopsis thaliana*]. {Gene NM_202163} |
| 120 | (NP_564996) caleosin-related family protein [*Arabidopsis thaliana*]. {Gene NM_105736} |
| 121 | (NP_564995) caleosin-related family protein [*Arabidopsis thaliana*]{Gene NM_105735} |

TABLE 3-continued

Examples of known oil body protein sequences

| SEQ. ID NO. | Oil Body Protein Motif (Amino Acid Sequence Identifier) {Nucleic Acid Sequence Identifier} |
|---|---|
| 122 | (NP_200335) caleosin-related family protein/embryo-specific protein, putative [*Arabidopsis thaliana*]. {Gene NM_124906} |
| 123 | (NP_173739) caleosin-related [*Arabidopsis thaliana*].{Gene NM_102174} |
| 124 | (NP_173738) caleosin-related family protein [*Arabidopsis thaliana*]{Gene NM_102173} |
| 125 | (AAQ74240) caleosin 2 [*Hordeum vulgare*]. {Gene AY370892} |
| 126 | (AAQ74239) caleosin 2 [*Hordeum vulgare*]. {Gene AY370891} |
| 127 | (AAQ74238) caleosin 1 [*Hordeum vulgare*]. {Gene AY370890} |
| 128 | (AAQ74237) caleosin 1 [*Hordeum vulgare*]. {Gene AY370889} |
| 129 | (AAF13743) caleosin [*Sesamum indicum*]. {Gene AF109921} |
| | Steroleosin |
| 130 | (XP_465935) putative steroleosin [*Oryza sativa (japonica* cultivar-group)]. {Gene XM_465935} |
| 131 | (XP_465933) putative steroleosin [*Oryza sativa (japonica* cultivar-group)]. {Gene XM_465933} |
| 132 | (AAT77030) putative steroleosin-B [*Oryza sativa (japonica* cultivar-group)]. {Gene AC096856} |
| 133 | (BAD23084) putative steroleosin [*Oryza sativa (japonica* cultivar-group)] {Gene AP004861} |
| 134 | (BAD23082) putative steroleosin [*Oryza sativa (japonica* cultivar-group)] {Gene AP004861} |
| 135 | (AAM46847) steroleosin-B [*Sesamum indicum*]. {Gene AF498264} |
| 136 | (AAL13315) steroleosin [*Sesamum indicum*]. {Gene AF421889} |
| 137 | (AAL09328) steroleosin [*Sesamum indicum*]. {Gene AF302806} |

SEQUENCE LISTING (251 sequences)

SEQ ID NO: 1 - DNA, 804 bp, Homo sapiens
atgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtga

SEQ ID NO: 2 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 3 - DNA, 731 bp, Homo sapiens
gatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgacgcgcgcgcgcccatgtggacgcgctgcgcacgcatctggccccctacagcgacgagctgcgccagtgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtga

SEQ ID NO: 4 - protein, 243 aa, Homo sapiens
DEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQCLAARLEALKENGGARLAEYHAKATEHLSTLSEKAKPALEDLRQGLLPVLESFKVSFLSALEEYTKKLNTQ

SEQ ID NO: 5 - DNA, 731 bp, Homo sapiens
gatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgacgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtga

SEQ ID NO: 6 - protein, 242 aa, Homo sapiens
DEPPQSPWDRVKDLATVYVDVLKDSGRDYVSQFEGSALGKQLNLKLLDNWDSVTSTFSLREQLGPVTQEFWDNLEKETEGLRQEMSKDLEEVKAKVQPYLDDFQKKWQEEMELYRQKVEPLRAELQEGARQKLHELQEKLSPLGEEMRDCARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 7 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVNTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRTKLGPHAGDVEGHLSFLEKDLRDKVNSFFSTFKEKESQDKTLSLPELEQQQEQHQEQQQEQVQMLAPLES

SEQ ID NO: 8 - protein, 317 aa, Homo sapiens [sequence omitted]

SEQ ID NO: 9 - protein, 262 aa, Danio rerio
MKFVALALTLLLALGSQANLFQADAPTQLEHYKAAALVYLNQVKDQAEKALDNLDGTDYEQYKLQLSESLTKLQEYAQTTSQALTPYAETISTQLMENTKQLRERVMTDVEDLRSKLEPHRAELYTALQKHIDEYREKLEPVFQEYSALNRQNAEQLRAKLEPLMDDIRKAFESNIEETKSKVVPMVEAVRTKLTERLEDLRTMAAPYAEEYKEQLVKAVEEAREKIAPHTQDLQTRMEPYMENVRTTFAQMYETIAKAIQA

SEQ ID NO: 10 - protein, 259 aa, Rattus norvegicus
MKAAVLAVALVFLTGCQAWEFWQQDEPQSQWDRVKDFATVYVDAVKDSGRDYVSQFESSTLGKQLNLNLLDNWDTLGSTVGRLQEQLGPVTQEFWANLEKETDWLRNEMNKDLENVKQKMQPHLDEFQEKWNEEVEAYRQKLEPLGTELHKNAKEMQRHLKVVAEEFRDRMRVNADALRAKFGLYSDQMRENLAQRLTEIRNHPTLIEYHTKAGDHLRTLGEKAKPALDDLGQGLMPVLEAWKAKIMSMIDEAKKKLNA

SEQ ID NO: 11 - protein, 265 aa, Bos taurus
MKAVVLTLAVLFLTGSQARHFWQQDDPQSSWDRVKDFATVYVEAIKDSGRDYVAQFEASALGKQLNLKLLDNWDTLASTLSKVREQLGPVTQEFWDNLEKETASLRQEMHKDLEEVKQKVQPYLDEFQKKWHEEVEIYRQKVAPLGEEFREGARQKVQELQDKLSPLAQELRDRARAHVETLRQQLAPYSDDLRQRLTARLEALKEGGGSLAEYHAKASEQLKALGEKAKPVLEDLRQGLLPVLESLKVSILAAIDEASKKLNAQ

SEQ ID NO: 12 - protein, 264 aa, Mus musculus
MKAVVLAVALVFLTGSQAWHVWQQDEPQSQWDKVKDFANVYVDAVKDSGRDYVSQFESSSLGQQLNLNLLENWDTLGSTVSQLQERLGPLTRDFWDNLEKETDWVRQEMNKDLEEVKQKVQPYLDEFQKKWKEDVELYRQKVAPLGAELQESARQKLQELQGRLSPVAEEFRDRMRTHVDSLRTQLAPHSEQMRESLAQRLAELKSNPTLNEYHTRAKTHLKTLGEKARPALEDLRHSLMPMLETLKTKAQSVIDKASETLTAQ

SEQ ID NO: 13 - protein, 56 aa, Ovis aries
LDNWDSLASTLSKVREQLGPVTQEFWDNLEKETASLRQEMHKDLEEARQKVQPYLD

SEQ ID NO: 14 - protein, 239 aa, Sus scrofa
MKAVVLTLAVLFLTGSQARHFWQQDDPQSPWDRVKDFATVYVDAIKDSGRDYVAQFEASALGKHLNLKLLDNWDSLGSTFTKVREQLGPVTQEFWDNLEKETEALRQEMSKDLEEVKKKVQPYLDDFQNKWQEEMETYRQKMAPLGAEFREGARQKVQELQEKLSPLAEELRDRLRAHVEALRQHVAPYSDDLRQRMAARFEALKEGGGSLAEYQAKAQEQKVSILAAIDEASKKLNAQ

SEQ ID NO: 15 - protein, 174 aa, Cyprinus carpio
LGQSVDNLHGYFQNGFQAITPIGDQVLEATKDTREKLVKDVEELRKKIEPMRAELRQVLEKHLQEYRDELKPFVEEYLTKHQKFLEEMRIKLEPVVKSLREKFGPNWEETKSKLMPILEAVREKVAEHLQDLKKLLEPYMQDYREQMEKGAQEFRQSVKSGELRKKMNELGRRR

SEQ ID NO: 16 - protein, 264 aa, Gallus gallus
MRGVLVTLAVLFLTGTQARSFWQHDEPQTPLDRIRDMVDVYLETVKASGKDAIAQFESSAVGKQLDLKLADNLDTLSAAAAKLREDMAPYYKEVREMWLKDTEALRAELTKDLEEVKEKIRPFLDQFSAKWTEELEQYRQRLTPVAQELKELTKQKVELMQAKLTPVAEEARDRLRGHVEELRKNLAPYSDELRQKLSQKLEEIREKGIPQASEYQAKVMEQLSNLREKMTPLVQEFRERLTPYAENLKNRLISFLDELQKSVA

SEQ ID NO: 17 - protein, 266 aa, Oryctolagus cuniculus
MKAVVLTLAVLFLTGSQARHFWQRDEPRSSWDKIKDFATVYVDTVKDSGREYVAQFEASAFGKQLNLKLLDNWDSLSSTVSKLQEQLGPVTQEFWDNLEKETEGLREEMNKDLQEVRQKVQPYLDEFQKKWQEEVERYRQKVEPLGAELRESARQKLTELQEKLSPLAEELRDSARTHVDTLRTKLAPYSNELQQRLAARLESIKEGGGASLAEYQAKAREHLSVLSEKARPALEDLRQGLLPVLESFKASVQNVLDEATKKLNTQ

SEQ ID NO: 18 - protein, 267 aa, Macaca fascicularis
MKATVLTLAVLFLTGSQARHFWQQDEPPQTPWDRVKDLVTVYVEALKDSGKDYVSQFEGSALGKQLNLKLLDNWDSVTSTVSKLREQLGPVTQEFWDNLEKETEGLRQEMSKDLEEVKAKVQPYLDDFQKKWQEEMELYRQKVEPLRAELHEGTRQKLHELHEKLSPLGEEVRDRARAHVDALRTHLAPYSDELRQRLAARLEALKENGGARLAEYHAKASEHLSTLSEKAKPALEDLRQGLLPVLESFKVSFLSALEEYTKKLSTQ

SEQ ID NO: 19 - protein, 264 aa, Coturniz japonica
MRGVLVTLAVLFLTGTQARSFWQHDDPQTPLDRIRDMLDVYLETVKASGKDAISQFESSAVGKQLDLKLADNLDTLSAAAAKLREDMTPYYREVREMWLKDTEALRAELTKDLEEVKEKIRPFLDQFSAKWTEEVEQYRQRLAPVAQELKDLTKQKVELMQAKLTPVAEEVRDRLREQVEELRKNLAPYSSELRQKLSQKLEEIRERGIPQASEYQAKVVEQLSNLREKMTPLVQEFKERLTPYAENLKNRLIDLLDEVQKTMA

SEQ ID NO: 20 - protein, 266 aa, Canis familiaris
MKAALLTLAVLFLTGSQARHFWQQDEPQSPWDRVKDLATVYVDAVKDSGRDYVAQFEASALGKQLNLKLLDNWDSLSSTVTKLREQIGPVTQEFWDNLEKETEVLRQEMSKDLEEVKQKVQPYLDDFQKKWQEEVELYRQKVAPLGSELREGARQKLQELQEKLSPLAEELRDRARTHVDALRAQLAPYSDDLRERLAARLEALKEGGGASLAEYHARASEQLSALGEKARPALEDLRQGLLPVLESFKVSLLAAIDEATKKLNAQ

SEQ ID NO: 21 - protein, 265 aa, Tupaia belangeri
MKAVVLTLAVLFLTGSQARHFWQQDEPQSSWDRVRDLANVYVDAVKESGREYVSQLEASALGKQLNLKLVDNWDTLGSTFQKVHEHLGPVAQEFWEKLEKETEELRREINKDLEDVRQKTQPFLDEIQKKWQEDLERYRQKVEPLSAQLREGARQKLMELQEQVTPLGEDLRDSVRAYADTLRTQLAPYSEQMRKTLGARLEAIKEGGSASLAEYHAKASEQLSALGEKAKPVLEDIHQGLMPMWESFKTGVLNVIDEAAKKLTA

SEQ ID NO: 22 - protein, 264 aa, Anus platurhynchos
MRVVVVTLALLFLTGTQARYFWQHDEPQAPLDRLRDLVDVYLETVKASGKDAIAQFEASAVGKQLDLKLADNLDTLGAAAAKLREDMAPYYKEVREMWLKDTESLRAELTKDLEEVKEKIRPFLDQFSAKWTEELEQYRQRLAPVAEELKELTKQKVELMQQKLTPVAEEARDRLRGHVEELRKNLAPYSDELRQKLSQKLEEIREKGIPQAAEYQAKVVEQLSNLREKMTPLVQDFKERLTPYAENLKTRFISLLDELQKTVA

SEQ ID NO: 23 - protein, 267 aa, Papio anubis; identical to SEQ ID NO: 18

SEQ ID NO: 24 - protein, 1420 aa, Macaca mulatta
PNVRWEYCNLTQCSDAEGTAVAPPNVTPVPSLEAPSEQAPTEQRPGVQECYHGNGQSYRGTYFTTVTGRTCQAWSSMTPHSHSRTPENYPNGGLIRNYCRNPDPVAAPYCYTMDPNVRWEYCNLTQCSDAEGIAVTPLTVTPVPSLEAPSKQAPTEQRPGVQECYHGNGQSYRGTYFTTVTGRTCQAWSSMTPHSHSRTPENYPNGGLIRNYCRNPDPVAAPYCYTMDPNVRWEYCNLTQCSDAEGTAVAPPNVTPVPSLEAPSEQAPTEQRSGVQECYHGNGQSYRGTYFTTVTGRTCQAWSSMKPHSHSRTPENYPNGGLIRNYCRNPDPVAAPYCYTMDPNVRWEYCNLTQCSDAEGTAVAPPNVTPVPSLEAPSEQAPTEQRLGVQECYHSNGQSYRGTYFTTVTGRTCQAWSSMTPHSHSRTPENYPNAGLVKNYCRNPDPVAAPWCYTTDPSVRWEYCNLTRCSDAEGTAVMPPNIIPVPSLEAFLEQEPTEETPGVQECYYHYGQSYRGTYSTTVTGRTCQAWSSMTPHQHSRTPKNYPNAGLTRNYCRNPDAEIRPWCYTMDPSVRWEYCNLTQCLVTESSVLETLTVVPDPSTQASSEEAPTEQSPEVQDCYHGDGQSYRGSFSTTVTGRTCQSWSSMTPHWHQRTTEYYPDGGLTRNYCRNPDAEIRPWCYTMDPSVRWEYCNLTQCPVTESSVLATSMAVSEQAPMEQSPGVQDCYHGDGQSYRGSFSTTVTGRICQSWSSMTPHWHQRTIEYYPNGGLTKNYCRNPDAEIRPWCYTMDPRVRWEYCNLTQCVVMESSVLATPMVVPVPSREVPSEEAPTENSPGVQDCYQGDGQSYRGTFSTTITGRTCQSWLSMTPHRHRRIPLRYPNAGLTRNYCRNRDAEIRPWCYTMDPSVRWEYCNLTQCPVTESSVLTTPTVVPVPSTEAPSEQAPPEKSPVVQDCYHGDGQSYRGTSSTTVTGRNCQSWSSMIPHWHQRTPENYPNAGLTRNYCRNPDSGKHPWCYTTDPCVRWEYCNLTQCSETESGVLETPTVVPVPSMEAHSEAAPTEQTPVVQQCYHGNGQSYRGTFSTTVTGRTCQSWSSMTPHQHKRTPENHPNDDLTMNYCRNPDADTGPWCFTMDPSVRREYCNLTRCSDTEGTVVTPPTVIPVPSLEAPSEQASSSFDCGKPQVEPKKCPGSIVGGCVAHPHSWPWQVSLRTRFGKHFCGGTLISPEWVLTAACCLETFSRPSFYKVILGAHQEVNLESHVQEIEVSRLFLEPIGADIALLKLSRPAIITDKVIPACLPSPNYVITAWTECYITGWGETQGTFGAGLLKEAQLHVIENTVCNHYEFLNGRVKSTELCAGHLAGGTDRCQGDNGGPVVCFDKDKYILRGITSWGPGCACPNKPGVYVRVSSFVTWIEGVMRNN

SEQ ID NO: 25 - protein, 391 aa, Rattus norvegicus
MFLKAVVLTVALVAITGTQAEVTSDQVANVMWDYFTQLSNNAKEAVEQLQKTDVTQQLNTLFQDKLGNINTYADDLQNKLVPFAVQLSGHLTKETERVREEIQKELEDLRANMMPHANKVSQMFGDNVQKLQEHLRPYATDLQAQINAQTQDMKRQLTPYIQRMQTTIQDNVENLQSSMVPFANELKEKFNQNMEGLKGQLTPRANELKATIDQNLEDLRSRLAPLAEGVQEKLNHQMEGLAFQMKKNAEELHTKVSTNIDQLQKNLAPLVEDVQSKLKGNTEGLQKSLEDLNKQLDQQVEVFRRAVEPLGDKFNMALVQQMEKFRQQLGSDSGDVESHLSFLEKNLREKVSSFMSTLQKKGSPDQPLALPLPEQVQEQVQEQVQPKPLES

SEQ ID NO: 26 - protein, 375 aa, Mus musculus
MFLKAAVLTLALVAITGTRAEVTSDQVANVVWDYFTQLSNNAKEAVEQFQKTDVTQQLSTLFQDKLGDASTYADGVHNKLVPFVVQLDLRDRMMPHANKVTQTFGENMQKLQEHLKPYAVDLQDQINTQTQEMKLQLTPYIQRMQTTIKENVDNLHTSMMPLATNLKDKFNRNMEELKGHLTPRANELKATIDQNLEDLRRSLAPLTVGVQEKLNHQMEGLAFQMKKNAEELQTKVSAKIDQLQKNLAPLVEDVQSKVKGNTEGLQKSLEDLNRQLEQQVEEFRRTVEPMGEMFNKALVQQLEQFRQQLGPNSGEVESHLSFLEKSLREKVNSFMSTLEKKGSPDQPQALPLPEQAQEQAQEQAQEQVQPKPLES

SEQ ID NO: 27 - protein, 435 aa, Mus musculus castaneus
MFLKAAVLTLALVAITGTRAKVTSDQVANVVWDYFTHLSNNAKEAAEQFQKTDVTQQLSTLFQDKLGDASTYADGVRNKLVPFVVQLSGHLAKETERVKEEIKKELEDLRDRMMPHANKVTQTFGENMQKLQEHLKPYAVDLQDQINTQTQEMKLQLTPYIQRMQTTIKENVDNLHTSMMPLATNLKDKFNRNMEELKGHLTPRANELKATIDQNLEDLRRSLAPLTVGVQEKLNHQMEGLAFQMKKNAEELQTKVSAKIDQLQKNLAPLVEDVQSKVKGNTEGLQKSLKDLNRQLEQQVEEFRRTVEPMGEMFNKALVQQLEQFRQQLGPNSGEVESHLSFLEKSLREKVNSFMSTLEKKGSPDQPQALPLPEQAQEQAQEQAQEQAQEQVQPKPLESGAPELSLSPSQQQTPVLPHHLSVTLSPGTSWTHVPT

SEQ ID NO: 28 - protein, 382 aa, Sus scrofa
MFLKAVVLSLALVAVTGARAEVNADQVATVMWDYFSQLGSNAKKAVEHLQKSELTQQLNTLFQDKLGEVNTYTEDLQKKLVPFATELHERLTKDSEKLKEEIRRELEELRARLLPHATEVSQKIGDNVRELQQRLGPFTGGLRTQVNTQVQQLQRQLKPYAERMESVLRQNIRNLEASVAPYADEFKAKIDQNVEELKGSLTPYAEELKAKIDQNVEELRRSLAPYAQDVQEKLNHQLEGLAFQMKKQAEELKAKISANADELRQKLVPVAENVHGHLKGNTEGLQKSLLELRSHLDQQVEEFRLKVEPYGETFNKALVQQVEDLRQKLGPLAGDVEGHLSFLEKDLRDKVNTFFSTLKEEASQGQSQALPAQEKAQAPLEG

SEQ ID NO: 29 - protein, 401 aa, Papio anubis
GARAEVSADQVATVMWDYFSQLSSNAKEAVEHLQKSELTQQLNALFQDKLGEVNTYAGDLQKKLVPFATELHERLAKDSKKLKEEIRKELEEVRARLLPHANEVSQKIGENVRELQQRLEPYTDQLRTQVNTQTEQLRRQLTPYAQRMERVLRENADSLQTSLRPHADQLKAKIDQNVEELKGRLTPYADEFKVKIDQTVEELRRSLAPYAQDAQEKLNHQLEGLAFQMKKNAEELKARISASAEELRQRLAPLAEDMRGNLRGNTEGLQKSLAELGGHLDRHVEEFRLRVEPYGENFNKALVQQMEQLRQKLGPHAGDVEGHLSFLEKDLRDKVNSFFSTFKEKESQDNTLSLPEPEQQQEQQQEQEQQQEQQEEQQQQEQQQEQEQQQEQVQMLAPLES

SEQ ID NO: 30 - protein, 429 aa, Macaca fascicularis
MFLKAVVLTLALVAVTGARAEVSADQVATVMWDYFSQLSSNAKEAVEHLQKSELTQQLNALFQDKLGEVNTYAGDLQKKLVPFATELHERLAKDSEKLKEEIRKELEEVRARLLPHANEVSQKIGENVRELQQRLEPYTDQLRTQVNTQTEQLRRQLTPYAQRMERVLRENADSLQTSLRPHADQLKAKIDQNVEELKERLTPYADEFKVKIDQTVEELRRSLAPYAQDAQEKLNHQLEGLAFQMKKNAEELKARISASAEELRQRLAPLAEDMRGNLRGNTEGLQKSLAELGGHLDRHVEEFRLRVEPYGENFNKALVQQMEQLRQKLGPHAGDVEGHLSFLEKDLRDKVNSFFSTFKEKESQDNTLSLPEPEQQREQQQEQQQEQEQEQQQQQEQQQQQEQQREQQQQEQQQEQQQEQVQMLAPLES

SEQ ID NO: 31 - protein, 91 aa, Pan troglodytes
RVEPYGENFNKALVQQMEQLRTKLGPHAGDVEGHLSFLEKDLRDKVNSFFSTFKEKESQDKTLSLPELEQQQEQQQEQQQEQVQMLAPLES

SEQ ID NO: 32 - protein, 401 aa, Papio sp.; identical to SEQ ID NO: 29

SEQ ID NO: 33 - protein, 167 aa, Gillichthys mirabilis
MKFLVALALISVCNANVVWHEQPKTLDLVRDTFWDYVAKATQMAEGSKQIQDSELGQEVNTKLSQSANTVQYVVALKTQAGPLSQDLLTQITQQTETLKSRLETELSAVNANLQPYAEQLVADLQTKMDALKDVAPLAEAMDPETLKTVMQTRTEDSSKLRWGRTPT

SEQ ID NO: 34 - protein, 15 aa, Oryctolagus cuniculus
EVSADQVATVMWDYF

SEQ ID NO: 35 - protein, 312 aa, Rattus norvegicus
MKALWALLLVPLLTGCLAEGELEVTDQLPGQSDQPWEQALNRFWDYLRWVQTLSDQVQEELQSSQVTQELTVLMEDTMTEVKAYKKELEEQLGPVAEETRARLAKEVQAAQARLGADMEDLRNRLGQYRNEVNTMLGQSTEELRSRLSTHLRKMRKRLMRDADDLQKRLAVYKAGAQEGAERGVSAIRERLGPLVEQGRQRTANLGAGAAQPLRDRAQALSDRIRGRLEEVGNQARDRLEEVREQMEEVRSKMEEQTQQIRLQAEIFQARIKGWFEPLVEDMQRQWANLMEKIQASVATNSIASTTVPLENQ

SEQ ID NO: 36 - protein, 281 aa, Danio rerio
MRSLVVFFALAVLTGCQARSLFQADAPQPRWEEMVDRFWQYVSELNTQTDGMVQNIKGSQLSRELDTLITDTMAELSSYSENLQTQMTPYASDAAGQLSKDLQLLAGKLQTDMTDAKERSTQYLQELKTMMEQNADDVKNRVGTYTRKLKKRLNKDTEEIRNTVATYMSEMQSRASQNADAVKDRFQPYMSQAQDGATQKLGAISELMKAQAQEVSEQLEVQAGALKEKLEETAENLRTSLEGRVDELTSLLAPYSQKIREQLQEVMDKIKEATAALPTQA

SEQ ID NO: 37 - protein, 316 aa, Bos taurus
MKVLWVAVVVALLAGCQADMEGELGPEEPLTTQQPRGKDSQPWEQALGRFWDYLRWVQTLSDQVQEELLNTQVIQELTALMEETMKEVKAYKEELEGQLGPMAQETQARVSKELQAAQARLGSDMEDLRNRLAQYRSEVQAMLGQSTEELRARMASHLRKLPKRLLRDADDLKKRLAVYQAGASEGAERSLSAIRERFGPLVEQGQSRAATLSTLAGQPLLERAEAWRQKLHGRLEEVGVRAQDRLDKIRQQLEEVHAKVEEQGNQMRLQAEAFQARLRSWFEPLVEDMQRQWAGLVEKVQLALRPSPTSPPSENH

SEQ ID NO: 38 - protein, 311 aa, Mus musculus
MKALWAVLLVTLLTGCLAEGEPEVTDQLEWQSNQPWEQALNRFWDYLRWVQTLSDQVQEELQSSQVTQELTALMEDTMTEVKAYKKELEEQLGPVAEETRARLGKEVQAAQARLGADMEDLRNRLGQYRNEVHTMLGQSTEEIRARLSTHLRKMRKRLMRDAEDLQKRLAVYKAGAREGAERGVSAIRERLGPLVEQGRQRTANLGAGAAQPLRDRAQAFGDRIRGRLEEVGNQARDRLEEVREHMEEVRSKMEEQTQQIRLQAEIFQARLKGWFEPIVEDMHRQWANLMEKIQASVATNPIITPVAQENQ

SEQ ID NO: 39 - protein, 305 aa, Canis familiaris
DVQPEPELERELEPKVQQELEPEAGWQTGQPWEAALARFWDYLRWVQTLSDQVQEGVLNTQVTQELTALMDETMKEVKAYKAELDEQLGPMTSETQARVAKELQAAQARLRADMEDVRNRLTQYRGELQAMLGQSSEELRARFASHMRKLRKRVLRDAEDLQRRLAVYKAGVREGAERSVSSIRERLWPLLEQARERNAKVGALATQPLLERADAWGQQLRGQLEEMSSRARGHLEEMREQIQEVRVKMEEQADQIRQKAEAFQARLKSWFEPLLEDMQRQWDGLVEKVQAAVATIPTSKPVEEP

SEQ ID NO: 40 - protein, 107 aa, Saimiri sciureus
LSSQVTQELTALMDETMKELKAYKSELEEQLSPVAEETRARLSKELQAAQARLGADMEDVRSRLAQYRSEVQAMLGQSTDELRARLASHLRKLRKRLLRDVDDLQKR

SEQ ID NO: 41 - protein, 107 aa, Macaca mulatta
LSPQVTQELTTLMDETMKELKAYKSELEEQLSPVAEETRARLSKELQAAQARLGADMEDVRSRLVQYRSEVQAMLGQSTEELRARLASHLRKLRKRLLRDADDLQKR

SEQ ID NO: 42 - protein, 317 aa, Sus scrofa
MRVLWVALVVTLLAGCRTEDEPGPPPEVHVWWEESKWQGSQPWEQALGRFWDYLRWVQSLSDQVQEELLSTKVTQELTELIEESMKEVKAYREELEAQLGPVTQETQARLSKELQAAQARVGADMEDVRNRLVLYRSEVHNMLGQTTEELRSRLASHLRNVRKRLVRDTEDLQKRLAVYQAGLREGAERSVSALRERLGPLVEQGRLRAATLSTRAGQPLRERAEAWGQKLRGRLEEMGSRTRDRLDEMRDELEEVRTKVEEQGSQLRLQAEAFQARLKGWFEPLVEDMRRQWAGLVERMQSAVSISSSTSAPSDNQ

SEQ ID NO: 43 - protein, 311 aa, Oryctolagus cuniculus
MKVWWAVLAAAILAGCRAQTEQEVEVPEQARWKAGQPWELALGRFWDYLRWVQSLSDQVQEELLSSQVTQELTMLMEETMKEVKAYKSELEEQLSPMAQEHRARLSKELQVAGALEADMEDVCNRLAQYRGEAQAMLGQSTEELARAFSSHLRKLRKRLLRDAEDLQKRMAVYGAGAREGAERGVSAVRERLGSRLERGRLRVATVGTLAGRPLRERAQAWGERLRGHLEEVGSRARDRLNEVREQVEEVRVKVEEQAPQMRLQAEAFQARLKSWFEPLVEDMQRQWAGLVEKLQAAMPSKAPAAAPIENQ

SEQ ID NO: 44 - protein, 317 aa, Papio anubis
MKVLWAALLVTFLAGCQAKVEQPVEPETEPDVRQQAEWQSGQPWELALGRFWDYLRWVQTLSEQVQEELLSPQVTQELTTLMDETMKELKAYKSELEEQLSPVAEETRARLSKELQAAQARLGADMEDVRSRLVQYRSEVQAMLGQSTEELRARLASHLRKLRKRLLRDADDLQKRLAVYQAGAREGAERGVSAIRERLGPLVEQGRVRAATVGSLASQPLQERAQALGERLRARMEEMGSRTRDRLDEVKEQVAEVRAKLEEQAQQISLQAEAFQARLKSWFEPLVEDMQRQWAGLVEKVQAAVGASTAPVPSDNH

SEQ ID NO: 45 - protein, 317 aa, Macaca fascicularis
MKVLWAALLVTFLAGCQAKVEQPVEPETEPELRQQAEGQSGQPWELALGRFWDYLRWVQTLSEQVQEELLSPQVTQELTTLMDETMKELKAYKSELEEQLSPVAEETRARLSKELQAAQARLGADMEDVRSRLVQYRSEVQAMLGQSTEELRARLASHLRKLRKRLLRDADDLQKRLAVYQAGAREGAERGVSAIRERLGPLVEQGRVRAATVGSLASQPLQERAQALGERLRARMEEMGSRTRDRLDEVKEQVAEVRAKLEEQAQQISLQAEAFQARLKSWFEPLVEDMQRQWAGLVEKVQAAVGASTAPVPIDNH

SEQ ID NO: 46 - protein, 298 aa, Cavia porcellus
MKVLWAALVVTLLAGCRADVEPEVEVREPAVWQSGQPWELALSRFWDYLRWVQTLSDQVQEELLSNQVTQELTLLIEDTMKEVKAYKAELEKELGPVAEDTKARLAKELQAAQARLGADMEEVRNRLSQYRSEVQAMLGQSSEELRARLTSHPRKMKRRLQRDIDELQKRMAVYKAGAQEGAERGVSAIRERLGSLIEQGRLQALASQPLQERAQAWGEQMRGRLEKVGSQARDRLEEVREQMEEVRVKVEEQAEAFQARLKSWFEPMMEDMRRQWAELIQKVQVAVGASTSAPSQEP

SEQ ID NO: 47 - protein, 329 aa, Zalophus californianus
MKVLWAALVVALLAGCWADVEPESPLEENLEPELEPKRELEQEVEPEAGWQAGQPWELALARFWDYLRWVQTLSDQVQEEVLSNQVTQELTTLMEETMKEIKAYRAELEEQLGPMASETQARVAKELQAAQARLRSDMEDVRTRLSQYRGEVQAMLGQSTEELRARFASHMRKLRKRVLRDAEDLQKRLAVYRAGVREGAERSVSTIRERLWPLLEQARTRHAKVDALATQPLRERVNALGQQLRGRLEEVGSRARSHLDEVREQMEEVQAKMEEQANQMRQQAEAFQARLKGWFEPLVEDMQRQWAVLVEKVQAAVGTSPTTPPVETK

SEQ ID NO: 48 - protein, 316 aa, Ovis sp.
MKVLWVALVVALLAGCQADMEGELGSEEPLPPEQPRGQDSQPWEQVLGRLWDYLRWVQTLSDQVQEELLNTQVIQELTVLMEETMKEVKAYREELEGQLAPMAQETQARVSKELQAAQARLGSDMEDLRNRLAQYRSEVQAMLGQSTEELRARMASHLRKLRKRLLRDADDLKKRLAVYQAGASEGAERSVSAIRERLRPLVEQSQSRAATLSTQVGQPLLDRAEAWRQKLHGRLEEVGVRAQDRLDKMRQQLEEVRSKVEEQGSQIRLQAEAFQARLRSWFEPLVEDMQRQWAGLVEKVQLALHLSPTSPPSENH

SEQ ID NO: 49 - protein, 317 aa, Pongo pygmaeus
MKVLWAALLVTFLAGCQAKVEQVVETEPEPELRQQAEWQSGQRWELALGRFWDYLRWVQTLSEQVQEELLSSQVTQELTALMDETMKELKAYKSELEEQLTPVAEETRARLSKELQAAQARLGADMEDVRGRLVQYRGEVQAMLGQSTEELRARLASHLRKLRKRLLRDADDLQKRLAVYQAGAREGAERGVSAIRERLGPLVEQGRVRAATVGSVAGKPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 50 - protein, 317 aa, Hylobates lar
MKVLWAALLVTFLAGCQAKVEQAVEPEPEPELRQQAEWQSGQPWELALGRFWDYLRWVQTLSEQVQEELLSSQVTQELTALMDETMKELKAYRSELEEQLTPVAEETRARLSKELQAAQARLGADMEDVRGRLVQYRGEVQAMLGQSTEELRARLASHLRKLRKRLLRDADDLQKRLAVYQAGAREGAERGVSAIRERLGPLVEQGRVRAATVGSLAGQPLQERAQAWGERLRARMEEVGGRTRDRLDEVKEQVAEVRAKLEEQAQQIRLQAEAFQARLKSWFEPLVEDMQRQWAGLVEKVQAAVGTSAAPVPSDNH

SEQ ID NO: 51 - protein, 317 aa, Gorilla gorilla
MKVLWAALLVTFLAGCQAKVEQAVETEPEPELHQQAEWQSGQRWELALGRFWDYLRWVQTLSEQVQEELLSSQVTQELTALMDETMKELKAYKSELEEQLTPVAEETRARLSKELQAAQARLGADMEDVRGRLAQYRGEVQAMLGQSTEELRARLASHLRKLRKRLLRDADDLQKRLAVYQAGAREGAERGVSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAMGTSAAPVPSDNH

SEQ ID NO: 52 - protein, 317 aa, Pan troglodytes
MKVLWAALLVTFLAGCQAKVEQVVETEPEPELHQQAEWQSGQRWELALGHFWDYLRWVQTLSEQVQEELLSSQVTQELTALMDETMKELKAYKSELEEQLTPVAEETRARLSKELQAAQARLGADMEDVRGRLVQYRGEVQAMLGQSTEELRARLASHLRKLRKRLLRDADDLQKRLAVYQAGAREGAERGVSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAMGTSAAPVPSDNH

SEQ ID NO: 53 - protein, 313 aa, Tupaia glis
MKVLWAVLAFAFLTGCRADVEPQLEPEVREPPKWQAGQPWELALGRFWDYLRWVQTLSDQVQEELLSSQVTQELTVLMEETMKEVKAYKAELEEQLGPMKEETQARLSKELQAAQARLGADMEDVRTRLAQYRSEVHTMLGQSTEELRARLSSHLRKMRKRLLRDAEDLQKRLAVYRAGVQEGAERGVSAIRERLGPLMEQGRLRANTVSALAVQPLQERAQAWGERLRGRLQEVGSQARDRLDEVREQVEEVRAKVEEQATQMRLQAEAFQARLQSWFEPLVKDVQRQWAELVEKVQAAVGTSAAPVSSENH

SEQ ID NO: 54 - protein, 275 aa, Oncorhynchus mykiss
MKAVAIILALAVISGCHARAVRQAEALPNLWEENVERFWTYVSEINSRADGLVENLKASQLSRELDTLITDTMAELTVYREDIQTKLVPYAQDTAALLGQDLQLLTTKLQTDMVDAKERSTQYLGELKTMMEQNADDVHNRVNTYTRKLKKRLNKDTEEIRNTVATYLGEIQSRTSQNMDLVKERVEPFVSQAHDTAAQRLGSFTDLLKNQAQDLSQQVSTQAEGMREQLEATAEDLRTTLEGKIDELSSLIAPYAAKIREHLQTAMDKVKETTV

SEQ ID NO: 55 - protein, 224 aa, Scophthalmus maximus
LENLKASQLSRELDTLITDTMSELSAYRNDLQTKISPYAEMSTGQLTQDLQLLANKLQKDMVDAKERSTQYLGELKTMVEQNTDDVRGRVTTYSNKLKKRLNKDTEEIRNTVATYLGELQSRTSQNLDTVSEHVQPYVQQASDSATKKLNDISTMVQNLAEGLGLQLETQAEGARTQLEATAKELFTSLEGKIDELSSLFSPYATQIQEQVGNIMDKVKETTSA

SEQ ID NO: 56 - DNA, 345 bp, Arabidopsis thaliana
atggcttcggaagaaggacaagtgatcgcctgccacaccgttgagacatggaacgagcagcttcagaaggctaatgaatccaaaactcttgtggtggttgatttcacggcttcttggtgtggaccatgtcgtttcatcgctccattctttgctgatttggctaagaaacttcctaacgtgcttttcctcaaggttgatactgatgaattgaagtcggtggcaagtgattgggcgatacaggcgatgccaaccttcatgtttttgaaggaagggaagattttggacaaagttgttggagccaagaaagatgagcttcagtctaccattgccaaacacttggcttaa

SEQ ID NO: 57 - DNA, 743 bp, Artificial Sequence
  soluble GFP
ggatccaaggagatataacaatgagtaaaggagaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagagctc

SEQ ID NO: 58 - protein, 25 aa, Nicotiana tabacum
MNFLKSFPFYAFLCFGQYFVAVTHA

SEQ ID NO: 59 - protein, 174 aa, Arabidopsis thaliana
MVSLLKLQKQHRTLNPYSLRKRKKEMADHQQHQQQQQPIMRSLHESSPSTRQIVRFVTAATIGLSLLVLSGLTLTGTVIGLIVATPLMVLFSPVLVPAVITIGLLTMGFLFSGGCGVAAATALTWIYKYVTGKHPMGADKVDYARMRIAEKAKELGHYTHSQPQQTHQTTTTTH

SEQ ID NO: 60 - protein, 199 aa, Arabidopsis thaliana
MADTHRVDRTDRHFQFQSPYEGGRGQGQYEGDRGYGGGGYKSMMPESGPSSTQVLSLLIGVPVVGSLLALAGLLLAGSVIGLMVALPLFLLFSPVIVPAALTIGLAMTGFLASGMFGLTGLSSISWVMNYLRGTRRTVPEQLEYAKRRMADAVGYAGQKGKEMGQHVQNKAQDVKQYDISKPHDTTTKGHETQGRTTAA

SEQ ID NO: 61 - protein, 174 aa, Arabidopsis thaliana; identical to SEQ ID NO: 59

SEQ ID NO: 62 - protein, 183 aa, Arabidopsis thaliana
MADVRTHSHQLQVHPQRQHEGGIKVLYPQSGPSSTQVLAVFVGVPIGGTLLTIAGLTLAGSVIGLMLAFPLFLIFSPVIVPAAFVIGLAMTGFLASGAIGLTGLSSMSWVLNYIRRAGQHIPEELEEAKHRLADMAEYVGQRTKDAGQTIEDKAHDVREAKTFDVRDRDTTKGTHNVRDTKTT

SEQ ID NO: 63 - protein, 169 aa, Arabidopsis thaliana
MADRTNPSSHTQQRPIYNSTTVPRSNTTTNHPLSSLLRQLLQSQSPNHSGQLFGFLAFFISGGILLLLTGITVTAFVLGFIAFLPLIIISSPIWIPLFLIVTGFLSLAGLILATGAVVSWLYRYFKGMHPLRSDQVDYARSRIHDTAAHVKDYAGGYFHGTLKDAAPGA

SEQ ID NO: 64 - protein, 191 aa, Arabidopsis thaliana
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVGYAGMKGKEMGQYVQDKAHEARETEFMTETHEPGKARRGS

SEQ ID NO: 65 - protein, 199 aa, Arabidopsis thaliana; identical to SEQ ID NO: 60

SEQ ID NO: 66 - protein, 183 aa, Arabidopsis thaliana; identical to SEQ ID NO: 62

SEQ ID NO: 67 - protein, 191 aa, Arabidopsis thaliana; identical to SEQ ID NO: 64

SEQ ID NO: 68 - protein, 183 aa, Arabidopsis thaliana; identical to SEQ ID NO: 62

SEQ ID NO: 69 - protein, 199 aa, Arabidopsis thaliana; identical to SEQ ID NO: 60

SEQ ID NO: 70 - protein, 191 aa, Arabidopsis thaliana
  misc_feature (160)..(160): Xaa can be any naturally occurring amino acid
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVSYAGMKGKXMGQYVQDKAHEARETEFMTETHEPGKARRGS

SEQ ID NO: 71 - protein, 141 aa, Arabidopsis thaliana
MADQTRTHHEMISRDSTQEAHPKARQMVKAATAVTAGGSLLVLSGLTLAGTVVALTVATPLLVIFSPVLVPAVVTVALIITGFLASGGFGIAAITAFSWLYRHMTGSGSDKIENARMKVGSRVQDTKYGQHNIGVQHQQVS

SEQ ID NO: 72 - protein, 167 aa, Arabidopsis thaliana
QKQHRTLNPYSLRKRKKEMADHQQHQQQQQPIMRSLHESSPSTRQIVRFVTAATIGLSLLVLSGLTLTGTVIGLIVATPLMVLFSPVLVPAVITIGLLTMGFLFSGGCGVAAATALTWIYKYVTGKHPMGADKVDYARMRIAEKAKELGHYTHSQPQQTHQTTTTTH

SEQ ID NO: 73 - protein, 166 aa, Arabidopsis thaliana
MAERFSSGEAQYWPNYGSTATTTVSNSPISSFFHQLRSHSPTSSQLFGFLALFISTGILLFLLGVSVTAAVLGFIVFLPLIIISSPIWIPVFVVVGGFLTVSGFLVGTVALVSWTYRYFRGMHPVGSNQMDYARSRIYDTASHVKDYAREYGGYFHGRAKDAAPGA

SEQ ID NO: 74 - protein, 166 aa, Arabidopsis thaliana; identical to SEQ ID NO: 73

SEQ ID NO: 75 - protein, 169 aa, Arabidopsis thaliana; identical to SEQ ID NO: 63

SEQ ID NO: 76 - protein, 226 aa, Arabidopsis lyrata
MFSFLILLLEVYKVVIAVVASIVFFVFSGLTLAGSAVALTVTTPLFIIFSPILVPATIATALLTTGFTAGGALGATAIALIRRSMGVKSKNNIPATGAPPTMFAQTPFNLTPKINYEGTFKGSWGGTSSPQAAPNFSYGGTWTATWGGRSFTGKFGDQSGGGGSTPEAAGAAADAGAGAGAGAGAGAGAGAGAAGAGAGAGAGAGAPGGAGTGTPAPPGKAGSKKK

SEQ ID NO: 77 - protein, 141 aa, Arabidopsis thaliana
MADQTRTHHEMISRDSTQEAHPKARQMVKAATAVTAGGSLLVLSGLTLAGTVIALTVATPLLVIFSPVLVPAVVTVALIITGFLASGGFGIAAITAFSWLYRHMTGSGSDKIENARMKVGSRVQDTKYGQHNIGVQHQQVS

SEQ ID NO: 78 - protein, 191 aa, Arabidopsis thaliana; identical to SEQ ID NO: 64

SEQ ID NO: 79 - protein, 199 aa, Arabidopsis thaliana; identical to SEQ ID NO: 60

SEQ ID NO: 80 - protein, 169 aa, Arabidopsis thaliana; identical to SEQ ID NO: 63

SEQ ID NO: 81 - protein, 173 aa, Arabidopsis thaliana
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTT

SEQ ID NO: 82 - protein, 191 aa, Arabidopsis thaliana
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVGYAGMKGKEMGQYVQDKAHEARETEFMTETHEPGKARRGP

SEQ ID NO: 83 - protein, 199 aa, Arabidopsis thaliana
MADTHRVDRTDRHFQFQSPYEGGRGQGQYEGDRGYGGGGYKSMMPESGPSSTQVLSLLIGVPVVGSLLALAGLLLAGSVIGLMVALPLFLLFSPVIVPAGLTIGLAMTGFLASGMFGLTGLSSISWVMNYLRGTKRTVPEQLEYAKRRMADAVGYAGQKGKEMGQHVQNKAQDVKQYDISKPHDTTTKGHETQGGTTAA

SEQ ID NO: 84 - protein, 191 aa, Arabidopsis thaliana; identical to SEQ ID NO: 64

SEQ ID NO: 85 - protein, 141 aa, Arabidopsis thaliana; identical to SEQ ID NO: 77

SEQ ID NO: 86 - protein, 173 aa, Arabidopsis thaliana; identical to SEQ ID NO: 81

SEQ ID NO: 87 - protein, 173 aa, Arabidopsis thaliana; identical to SEQ ID NO: 81

SEQ ID NO: 88 - protein, 153 aa, Arabidopsis thaliana
MAPFPLSLIFGKKKRRRDDEIRRQKPTLKGVMTAFFATEAAICLLLLAGISLTGTAVALFASMPLFLVFSPVLVPAGIATTILASGLMAGGTSGVSGLTILMWLYKKYTGRDFPIKIPGAAAAGGAAPAAPAAPAPAAPAAKPAAKPAAKPGA

SEQ ID NO: 89 - protein, 173 aa, Arabidopsis thaliana; identical to SEQ ID NO: 81

SEQ ID NO: 90 - protein, 199 aa, Arabidopsis thaliana; identical to SEQ ID NO: 60

SEQ ID NO: 91 - protein, 191 aa, Arabidopsis thaliana; identical to SEQ ID NO: 64

SEQ ID NO: 92 - protein, 141 aa, Arabidopsis thaliana; identical to SEQ ID NO: 77

SEQ ID NO: 93 - protein, 173 aa, Arabidopsis thaliana; identical to SEQ ID NO: 81

SEQ ID NO: 94 - protein, 199 aa, Arabidopsis thaliana; identical to SEQ ID NO: 83

SEQ ID NO: 95 - protein, 191 aa, Arabidopsis thaliana; identical to SEQ ID NO: 64

SEQ ID NO: 96 - protein, 153 aa, Arabidopsis thaliana; identical to SEQ ID NO: 88

SEQ ID NO: 97 - protein, 175 aa, Brassica napus
RRDQYPRDRDQYSMIGRDRDKYSMIGRDRDQYNMYGRDYSKSRQIAKAVTAVTAGGSLLVLSSLTLVGTVIALTVATPLLVIFSPILVPALITVALLITGFLSSGGFGIAAITVFSWIYKYATGEHPQGSDKLDSARMKLGGKVQDMKDRAQYYGQQQTGGEDDRDRTRGTQHTT

SEQ ID NO: 98 - protein, 216 aa, Brassica oleracea
RFFRMFSFIFPLLNVIKLIIASVTSLVCLAFSCVTLGGSAVALIVSTPLFIIFSPILVPATIATTLLASGLMAGTTLGLTGIGLITGLVRTAGGVTLAESPIRRIIINRIKARLGGGGGSRLAMLKKILGLIKKLRGMSSGGAAPALKQHQQLRPRMELHPRHLHRPNKERWFMLFQYVAHKNCVIINLRIYDSETKKKIALLLSFIQYSFLCNNV

SEQ ID NO: 99 - protein, 195 aa, Brassica napus
MTDTARTHHDITSRDQYPRDRDQYSMIGRDRDQYSMMGRDRDQYNMYGRDYSKSRQIAKAVTAVTAGGSLLVLSSLTLVGTVIALTVATPLLVIFSPILVPALITVAMLITGFLSSGGFGIAAITVFSWIYKYATGEHPQGSDKLDSARMKLGSKAQDLKDRAQYYGQQHTGGYGQQHTGGEHDRDRTRGTQHTT

SEQ ID NO: 100 - protein, 183 aa, Brassica napus
PARTHHDITTRDQYPLISRDRDQYGMIGRDQYNMSGQNYSKSRQIAKATTAVTAGDSLLVLSSLTLVGTVIALIVATPLLVIFSPILVPALITVALLITGFLSSGAFGIAAITVFSWIYKYATGEHPQGSDKLDSARMKLGSKAQDMKDRAYYYGQQHTGEEHDRDRDHRTDRDRTRGTQHTT

SEQ ID NO: 101 - protein, 183 aa, Brassica napus; identical to SEQ ID NO: 100

SEQ ID NO: 102 - protein, 195 aa, Brassica napus; identical to SEQ ID NO: 99

SEQ ID NO: 103 - protein, 175 aa, Brassica napus; identical to SEQ ID NO: 97

SEQ ID NO: 104 - protein, 195 aa, Brassica napus; identical to SEQ ID NO: 99

SEQ ID NO: 105 - protein, 165 aa, Brassica napus
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAVAPAAAPAAAPAPKPAAPPAPKPAAAPSI

SEQ ID NO: 106 - protein, 375 aa, Brassica napus
MKEEIQNETAQTQLQREGRMFSFLFPVIEVIKVVMASVASVVFLGFGGVTLACSAVALAVSTPLFIIFSPILVPATIATTLLATGLGAGTTLGVTGMGLLMRLIKHPGKEGAASAPAAQPSFLSLLEMPNFIKSKMLERLIHIPGVGKKSEGRGESKGKKGKKGKSEHGRGKHEGEGKSKGRKGHRMGVNPENNPPPAGAPPTGSPPAAPAAPEAPAAPAAPAAPAAPAAPAAPAAPEDPAAPAAPEAPATPAAPPAPAAAPAPAAPAAPPAPAAPPRPPSFLSLLEMPSFIKSKLIEALINIPGFGKKSNDRGKSKGGKKSKGKGKSNGRGKHEGEGKSKSRKSKSRGKDKEKSKGKGIFGRSSRKGSSDDESS

SEQ ID NO: 107 - protein, 168 aa, Daucus carota
  misc_feature (55)..(55): Xaa can be any naturally occurring amino acid
  misc_feature (139)..(139): Xaa can be any naturally occurring amino acid
  misc_feature (159)..(159): Xaa can be any naturally occurring amino acid
NKFTLSNLISVDFMAMYQSPQFTRHHDALQPAALNSSGQGHHSSHHRRSVMLLSXLTLVATVIGLVIATPVMVIFSPVLVPAGLPAAPARRVSHGGGAGGHRAFVLFWMYRYTAGKHPIGANQLDFAATRLRMRKEKGXIWGMSRFRLFRGVEEVVRRXGNDEGFLAV

SEQ ID NO: 108 - protein, 168 aa, Daucus carota; identical to SEQ ID NO: 107
  misc_feature (55)..(55): Xaa can be any naturally occurring amino acid
  misc_feature (139)..(139): Xaa can be any naturally occurring amino acid
  misc_feature (159)..(159): Xaa can be any naturally occurring amino acid

SEQ ID NO: 109 - protein, 187 aa, Zea mays
MADRDRSGIYGGAHATYGQQQQQGGGGRPMGEQVKKGMLHDKGPTASQALTVATLFPLGGLLLVLSGLALTASVVGLAVATPVFLIFSPVLVPAALLIGTAVMGFLTSGALGLGGLSSLTCLANTARQAFQRTPDYVEEARRRMAEAAAQAGHKTAQAGQAIQGRAQEAGTGGGAGAGAGGGGRASS

SEQ ID NO: 110 - protein, 187 aa, Zea mays; identical to SEQ ID NO: 109

SEQ ID NO: 111 - protein, 156 aa, Zea mays
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPAADQLDHAKARLASKARDVKDAAQHRIDQAQGS

SEQ ID NO: 112 - protein, 175 aa, Zea mays
MADRDRSGIYGGGAYGQQQGRPPMGEQVKGMIHDKGPTASQALTVATLFPLGGLLLVLSGLALAASTVGLAVATPVFLLFSPVLVPAALLIGTAVAGFLTSGALGLGGLSSLTCLANTARQAFQRTPDYVEEARRRMAEAAAHAGHKTAQAGHGIQSKAQEAGAGTGAGGGRTSS

SEQ ID NO: 113 - protein, 156 aa, Zea mays; identical to SEQ ID NO: 111

SEQ ID NO: 114 - protein, 187 aa, Zea mays; identical to SEQ ID NO: 109

SEQ ID NO: 115 - protein, 156 aa, Zea mays; identical to SEQ ID NO: 111

SEQ ID NO: 116 - protein, 175 aa, Zea mays; identical to SEQ ID NO: 112

SEQ ID NO: 117 - protein, 217 aa, Oryza sativa
MALVLFASSSSCKRPVTHNILCGTRAKGSPAAAAAVGAATELQKHVAFFDSNHDGIISFSETYEGFRALGFGVVTSRFSATVINGALGTKTRPENATASRFSIYIENIHKGVHGSDTGAFDSEGRFVNEKFDEIFTKHAKTVPDGLTAAELDEMLRANREPKDYKGWVGASTEWETTFKLGKDKDGFLRKDTVRTVYDGSFFSKVASKKKGPSANQA

SEQ ID NO: 118 - protein, 217 aa, Oryza sativa; identical to SEQ ID NO: 117

SEQ ID NO: 119 - protein, 174 aa, Arabidopsis thaliana
MFFCFCFCESKKGLCMETYLWDYVVYVGGKLDKEKMTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWFVVSELFQTN

SEQ ID NO: 120 - protein, 192 aa, Arabidopsis thaliana
MASSISAAEVKVVPEEYNFLQKHVAFFDRNKDGIVYPSETFQGFRAIGCGYLLSTFAAVFINISLSSKTRPGKGFSFSFPIEVKNVRLGIHSSDSGVYDKDGRFVASKFEEIFAKHAHTHRDALTSKELKELLKANREPNDCKGGILAFGEWKVLYNLCKDKSGLLHKEIVRAVYDGSLFEQLEKQRSSKTP

SEQ ID NO: 121 - protein, 195 aa, Arabidopsis thaliana
MASSISTGVKFVPEEDNFLQRHVAFFDRNKDGIVYPSETFQGFRAIGCGYLLSAVASVFINIGLSSKTRPGKGFSIWFPIEVKNIHLAKHGSDSGVYDKDGRFVASKFEEIFTKHAHTHRDALTNEELKQLLKANKEPNDRKGWLAGYTEWKVLHYLCKDKNGLLHKDTVRAAYDGSLFEKLEKQRSSKTSKKHP

SEQ ID NO: 122 - protein, 243 aa, Arabidopsis thaliana
MTSMERMERDAMETVAPYARVTYHRRVRGDLDDTLPKPYLPRALQAPDMEHPQGTPDHRHNGLSVLQQHVAFFDLDNNGIIYPFETFSGFRLLGFNLLASLILAAGINIALSYATLPGWLPSPFFPIYIHNIHKAKHGSDSKTYDNEGRYTPANLELMFSKYARTIPDKLSLGELWDMTEGNRDAFDFFGWLASKVEWGVLYALASDEEGFLSKEAIRRCFDGSLFEYCAKNYAEIKEYKTYY

SEQ ID NO: 123 - protein, 175 aa, Arabidopsis thaliana
MCPSLTETVTALFIHEKPTKGFRALGTGRFMSAFVAVFFNMGLSQKTRPVQLFGYILPLFLKPFVCTVVTTDVYDKDGRFVESKFEEIFNKHARTHKDALTAKEIKQMLKTNREPYDFIGWLSDFIEWKILHTLAQDNGLLTEDAVRGVYDGSLFQQLEKKRSSSSSRGKKQKLP

SEQ ID NO: 124 - protein, 184 aa, Arabidopsis thaliana
MTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWLSDYGEWKILHTLAQDKNGLLSEKSVRAIYDGSLFHQLEKKRSSSSSRGKKQKLP

SEQ ID NO: 125 - protein, 246 aa, Hordeum vulgare
MAGEDATRAATEEELSSVAEAAPVTAQRPVRSDLEKYIPKPYLARALVAPDVYHPQGSKERGHEHRHRSVLQQHVAFFDMDGDGVIYPWETYQGLRALGFNMIVSFVIVIIIHATLSYTTLPSWVPSLLFPFYIDNIHRAKHGSDTATYDTEGRYMPVNFENIFSKNARSSPDKLTFREIWTMTDDQRQANDPFGWVASKAEWILLYMLAKDEEGNLPREAIRRCFDGSLFEFIADERRQAHGKQY

SEQ ID NO: 126 - protein, 246 aa, Hordeum vulgare; identical to SEQ ID NO: 125

SEQ ID NO: 127 - protein, 301 aa, Hordeum vulgare
MATKARKVEVRDASRAEGKGDAADVHVLREAMRADGKGDHDTAGGANRADGHGDAGGRVGDSRGVDGKDSLKMVALQAPVTVERPVRGDLEEHVPKPYLARALAAPDMYHPEGTTTDDHQHHNMSVLQQHVAFFDRDNNGIIYPWETYDGCRAVGFNVFMSAFIAFLVNLVMSYPTLPGWLPNPLFPIYVHNIHKSKHGSDSGTYDKEGRFMPVNFENIFSKYARTYPDRLSYREMWRMTEGCREVFDFFGWVAMKLEWSILYALARDDEGYLSREAIRRMYDGSLFEYMERQRMEHVKMS

SEQ ID NO: 128 - protein, 301 aa, Hordeum vulgare; identical to SEQ ID NO: 127

SEQ ID NO: 129 - protein, 245 aa, Sesamum indicum
MATHVLAAAAERNAALAPDAPLAPVTMERPVRTDLETSIPKPYMARGLVAPDMDHPNGTPGHVHDNLSVLQQHCAFFDQDDNGIIYPWETYSGLRQIGFNVIASLIMAIVINVALSYPTLPGWIPSPFFPIYLYNIHKAKHGSDSGTYDTEGRYLPMNFENLFSKHARTMPDRLTLGELWSMTEANREAFDIFGWIASKMEWTLLYILARDQDGFLSKEAIRRCYDGSLFEYCAKMQRGAEDKMK

SEQ ID NO: 130 - protein, 395 aa, Oryza sativa
MDLYLMFHSVLMHVAAALVVLVYIPLSMPVKLFLWAFVKPLRKESLRGKVVLITGASSGIGEELAYQYAAQGACLALVARRKKALEGVAAAALERGSPDVLVLPADVSDADQSRRAVEETVAHFGKLNHLVANAGIWSSCSFDEVTNITAFTKMMDVNFWGSVYPTYYALPHLKASKGKLVVSCSAAGTVGTSRMSFYNATKAAQLRFYETLRAELGSEVGITVLTPGYVESEITKGKGIQSGGDVAVNEEARDEQIGVFPVGRVAELGEVAMDGIRAGDWYVTWPSLFRPLQLVACLAPGVLDWACRALYGTRKGARPPLGKRIMEATGMKRLFPEALRRNPAIKTEDEEYCDGEEGYGAADDAAAAYLLQCRKGLRAAHTYIRCIFSLSDSIL

SEQ ID NO: 131 - protein, 357 aa, Oryza sativa
MKTQLFSDDALSVMKEACILVVASLEINQMDGATFCEANLFYFQFEDGHRDKRNVTLELAYQYASKGASLALVARRKQALKSVAAAARERGAPDVLVLDADVSDAGQSRRAVEETIAHYGKLNHLVANAGIWSTCPFDEITNITAFTTIMDVNFWGAVYPTYYALPHLKASRGKLVVCSSAAGTVATSRMSFYNASKAAVLRFYETLRAELGSEVGVTILTHGYVESEMTMGKAVQKDGVLVVDQEARDVQIGVFPVGGVGAMCRVAMDGIRRGDRYVTWPSVYRPLQLVACLAPEIVSWLSYAMYNTKAGGGAPLSKRALDATGARRFFPEGLRRNPVVIKTDEECDGDEGVAACN

SEQ ID NO: 132 - protein, 355 aa, Oryza sativa
MEQVVNAVLDLVVPPASMVMLAFAWPTLSFLRGVEWVVKTLTVENMHNKVVLITGASSAIGEQIAYEYARRNANLVLVARREHRLFAVRENARALGAGQVLVIAADVVKEDDCRRLVGDTISFFGQLNHLVNTVSLGHDFCFEEAGDTVAFPHLMDVNFWGNVYPTYAALPYLRRSHGRVVVNAAVEIWLPMPRMTLYSAAKAAVIDFYESLRYEVGDEVGISVATHGWIGGEASGGKFMLEEGAEMQWKGEEREVPLAGGQVEAYARMVVAGACRGDAHVKHPNWYDVFLVFRAFAPDVLAWTFRLLLSTPSPSPPASARRHQLAALPAPPLHPLLEYPSARSPGRAAQQHKLE

SEQ ID NO: 133 - protein, 395 aa, Oryza sativa; identical to SEQ ID NO: 130

SEQ ID NO: 134 - protein, 357 aa, Oryza sativa; identical to SEQ ID NO: 131

SEQ ID NO: 135 - protein, 362 aa, Sesamum indicum
MDLINSLLNFVVPPASLLMLAFTWPTLFFITTCEWLYNTYLNSENMENKVVLITGASSGIGEQIAYQYAKRGANLVLVARREHRLRGISENARRLGAPNVLIMAADVVKEEECRRFINETINYYGRVDHLVNTVSLGHTFYFEEASDSSVFPILMDINFWGNVYPTYVALPYLRESNGRIIVNASVENWLPLPRMSLYSAAKSALINFYETLRFEVKNEVGITVATHGWIGTEMTRGKFMVEEGAEMQWKEEREVHVTGGPVEEFAKQIVSGACRGDPYVKYPSWYDIFFLYRVFAPKVLDWTFRFLLTNGGARRTSFIGTGRPLLETSSPRRSAVMEGSSPRRLPPGPLTFSPAFQQQKSE

SEQ ID NO: 136 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 137 - protein, 348 aa, Sesamum indicum; identical to SEQ ID NO: 136

SEQ ID NO: 138 - protein, 118 aa, Arabidopsis thaliana
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYK

SEQ ID NO: 139 - protein, 187 aa, Brassica napus
MADTARTHHDVTSRDQYPRDRDQYSMIGRDRDQYSMMGRDRDQYNMYGRDYSKSRQIAKAVTAVTAGGSLLVLSSLTLVGTVIALTVATPLLVIFSPILVPALITVALLITGFLSSGGFAIAAITVFSWIYKYATGEHPQGSDKLDSARMKLGTKAQDIKDRAQYYGQQHTGGEHDRDRTRGGQHTT

SEQ ID NO: 140 - DNA, 748 bp, Arabidopsis thaliana
taccatggggtcaaagacggagatgatggagagagacgcaatggctacggtggctccctatgcgccggtcacttaccatcgccgtgctcgtgttgacttggatgatagacttcctaaaccttatatgccaagagcattgcaagcaccagacagagaacacccgtacggaactccaggccataagaattacggacttagtgttcttcaacagcatgtctccttcttcgatatcgatgataatggcatcatttacccttgggagacctactctggactgcgaatgcttggtttcaatatcattgggtcgcttataatagccgctgttatcaacctgacccttagctatgccactcttccggggtggttaccttcacctttcttccctatatacatacacaacatacacaagtcaaagcatggaagtgattcaaaaacatatgacaatgaaggaaggtttatgccggtgaatcttgagttgatatttagcaaatatgcgaaaaccttgccagacaagttgagtcttggagaactatgggagatgacagaaggaaaccgtgacgcttgggacatttttggatggatcgcaggcaaaatagagtggggactgttgtacttgctagcaagggatgaagaagggtttttgtcaaaagaagctattaggcggtgtttcgatggaagcttgttcgagtactgtgccaaaatctacgctggtatcagtgaagacaagacagcatactacgccatggat

SEQ ID NO: 141 - DNA, 738 bp, Arabidopsis thaliana
atggggtcaaagacggagatgatggagagagacgcaatggctacggtggctccctatgcgccggtcacttaccaccgccgtgctcgtgttgacttggatgatagacttcctaaaccttatatgccaagagcattgcaagcaccagacagagaacacccgtacggaactccaggccataagaattacggacttagtgttcttcaacagcatgtctccttcttcgatatcgatgataatggcatcatttacccttgggagacctactctggactgcgaatgcttggtttcaatatcattgggtcgcttataatagccgctgttatcaacctgacccttagctatgccactcttccggggtggttaccttcacctttcttccctatatacatacacaacatacacaagtcaaagcatggaagtgattcaaaaacatatgacaatgaaggaaggtttatgccggtgaatcttgagttgatatttagcaaatatgcgaaaaccttgccagacaagttgagtcttggagaactatgggagatgacagaaggaaaccgtgacgcttgggacatttttggatggatcgcaggcaaaatagagtggggactgttgtacttgctagcaagggatgaagaagggtttttgtcaaaagaagctattaggcggtgtttcgatggaagcttgttcgagtactgtgccaaaatctacgctggtatcagtgaagacaagacagcatactactaa

SEQ ID NO: 142 - DNA, 1047 bp, Sesamum indicum
atggatctaatccacactttcctcaacttaatagctccccctttcaccttcttcttccttctctttttcttgccacccttccagattttcaagttcttcctttcaatcttgggcacccttttcagcgaggatgtcgctggaaaagtcgtcgtcatcaccggcgcctcctccggcatcggcgaaagtcttgcttacgagtatgctaagagaggggcgtgcttggtgcttgctgcaagaagggaaaggagtcttcaagaagtggccgaaagggcgcgcgatttggggtcgccggacgtcgtggtggtccgggccgatgtttcgaaggcggaggactgcaggaaggttgttgatcagactatgaatcgctttggaagattggatcacctggtcaataacgctggaattatgtcagtttcaatgctggaagaagttgaagatattactggttacagagaaactatggatatcaacttctggggctatgtgtatatgacccgatttgccgccccataccttaggaatagcagaggccgaattgttgtactttcttcatccagttcttggatgcctactccgaggatgagtttttacaatgcaagcaaagcggcgatttcacaattttttgagacactgcgggtggaattcggccccgatataggcataacccttgtgactccaggattcatagaatctgaacttacccaaggcaaattctacaatgctggcgaacgtgtaattgatcaggacatgagagatgtacaagtgagcacgactccaatcctgagggtggaaagtgcggcaaggtcaatcgtgaggagcgcgatccgtggagaaagatacgtgacagagccggcctggtttagggttacttattggtggaagctattctgccctgaggtgatggagtgggtatttagactgatgtacttggccagcccgggtgagccggagaaggaaacgtttggcaagaaggttttggattacacaggagtgaagtccttgctttacccggaaaccgtgcaagttccggagcccaagaatgattaa

SEQ ID NO: 143 - DNA, 108 bp, Artificial Sequence
  klip8
atggctgagatcacccgcattcctctctacaaaggtaagtctctccgtaaggcgctgaaggaacatggacttctagaagacttcttgcagaaacaacagtatggcatc

SEQ ID NO: 144 - DNA, 4233 bp, Artificial Sequence
  Apo10
gaattcattgtactcccagtatcattatagtgaaagttttggctctctcgccggtggttttttacctctatttaaaggggttttccacctaaaaattctggtatcattctcactttacttgttactttaatttctcataatctttggttgaattatcacgcttccgcacacgatatccctacaaatttattatttgttaaacattttcaaaccgcataaaattttatgaagtcccgtctatctttaatgagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataatataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaatctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgctattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccagacactctgtggtcttttggttcatgcatgggtcttgcgcaagaaaaagacaaagaacaaagaaaaaagacaaaacagagagacaaaacgcaatcacacaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctcaatatcactcacttctttcatcatccatccatccagagtactactactctactactataataccccaacccaactcatattcaatactactctaccatggatgaacccccccagagcccctgggatcgagtgaaggacctggccactgtgtacgtggatgtgctcaaagacagcggcagagactatgtgtcccagtttgaggctccgccttgggaaaacagctaaacctaaagctccttgacaactgggacagcgtgacctccaccttcagcaagctgcgcgaacagctcggccctgtacccaggagttctgggataacctggaaaaggagacagagggcctgaggcaggagatgagcaaggatctggaggaggtgaaggccaaggtgcagccctactggacgacttccagaagaagtggcaggaggagatggagctctaccgccagaaggtggagccgctgcgcgcagagctccaagagggcgcgcgccagaagcgcacgagctgcaagagaagctgagcccactgggcgaggagatgcgcgaccgcgcgcgcgcccatgtggacgcgctgcgcacgcatctggccccctacaggacgagctgcgccagcgcttggccgcgcgccttgaggctctcaaggagaacggcggcgccagactggccgagtaccacgccaaggccaccgagcatctggcacgctcagcgagaaggccaagcccgcgctcgaggacctccgccaaggcctgctgcccgtgctggagagcttcaaggtcagcttcctgagcgctctcgggagtacactaagaagctcaacacccaggggatccccttggctagtaaaggagaagaacttttcactggagttgtcccaattcttgttgaattagatgggatgttaatgggcacaaattttctgtcagtggagagggtgaaggtgatgctacatacggaaagcttacccttaaatttatttgcactactggaaaactactgttccttggccaacacttgtcactactttctcttatggtgttcaatgcttttcaagatacccagatcatatgaagcggcacgacttcttcaagagcgcatgcctgagggatacgtgcaggagaggaccatctctttcaaggacgacgggaactacaagacacgtgctgaagtcaagtttgagggagacaccctcgtaacaggatcgagcttaagggaatcgatttcaaggaggacggaaacatcctcggccacaagttggaatacaactacaactcccacaacgtatacatcacgcagacaaacaaaagaatggaatcaaagctaacttcaaaattagacacaacattgaagatggaagcgttcaactagcagaccattatcaacaaaatactcaattggcgatggccctgtccttttaccagacaaccattacctgtccacacaatctgccctttcgaaagatcccaacgaaaagagagaccacatggtcctcttgagtttgtaacagctgctgggattacacatggcatggatgaactatacaaataagtcatgactgcagtctagatttaaatgcaagcttaaataagttgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcggacggcttatggaatgcttcaaatagtacaaaaacaaatgtgtactataagactttctaaacaattctaactttagcattgtgaacgagacataagtgtaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccagatatttctaatattttagttgatatgtatatgaaaaggtactatttgaactctcttactctgtataaaggttggatcatccttaaagtgggtctatttattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaatttttaaacgagagtaaacatatttgactttttggttatttaacaaattattatttaacactatatgaaattttttttttttatcagcaaagaaataaaataaattaagaaggacaatggtgtgtcccaatccttatacaaccaacttccacaagaaagtcaagtcagagacaacaaaaaaacaagcaaaggaaatttttaatttgagttgtcttgtttgctgcataatttatgcagtaaaacactacacataacccttttagcagtagagcaatggttgaccgtgtgcttagcttctttattttatttttttatcagcaaagaataaataaaataaaatgagacacttcagggatgtttcaacccttatacaaaaccccaaaaacaagtttcctagcaccctaccaactaa

SEQ ID NO: 145 - protein, 486 aa, Artificial Sequence
  Apo10
MDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQGIPLASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 146 - DNA, 22 bp, Artificial Sequence
  forward primer 1186
ggatccccttggctagtaaagg

SEQ ID NO: 147 - DNA, 40 bp, Artificial Sequence
  reverse primer 1187
aagctttctagactgcagtcatgacttatttgtatagttc

SEQ ID NO: 148 - DNA, 30 bp, Artificial Sequence
  forward primer 1190
ccatggggcggcatttctggcagcaagatg

SEQ ID NO: 149 - DNA, 29 bp, Artificial Sequence
  reverse primer 1189
ggatcccctgggtgttgagcttcttagtg

SEQ ID NO: 150 - DNA, 4285 bp, Artificial Sequence
  Apo 11
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagtctagatttaaatgcaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 151 - protein, 493 aa, Artificial Sequence
  Apo11
MGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQGIPLASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 152 - DNA, 28 bp, Artificial Sequence
  forward primer 1191
ccatggatgaacccccccagagcccctg

SEQ ID NO: 153 - DNA, 5023 bp, Artificial Sequence
  Apo12
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagtctagatttaaatgcaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 154 - protein, 659 aa, Artificial Sequence
  Apo12
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQGIPLASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 155 - DNA, 5044 bp, Artificial Sequence
  Apo13
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagtctagatttaaatgcaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 156 - protein, 666 aa, Artificial Sequence [sequence omitted]

SEQ ID NO: 157 - DNA, 4339 bp, Artificial Sequence
  Apo15
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagtctagatttaaatgcaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 158 - protein, 511 aa, Artificial Sequence
  Apo15
MNFLKSFPFYAFLCFGQYFVAVTHAMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQGIPLASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 159 - DNA, 4360 bp, Artificial Sequence
  Apo16
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagtctagatttaaatgcaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 160 - protein, 518 aa, Artificial Sequence
  Apo16
MNFLKSFPFYAFLCFGQYFVAVTHAMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQGIPLASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 161 - DNA, 1461 bp, Artificial Sequence
  Apo17
atggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataa

SEQ ID NO: 162 - protein, 486 aa, Artificial Sequence; identical to SEQ ID NO: 145
  Apo17

SEQ ID NO: 163 - DNA, 2970 bp, Artificial Sequence
  Apo18
aattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcatttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagccccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcagaatgagttccaagatggtttgtgacgaagttagttggttgtttttatggaactttgtttaagcttgtaatgtggaaagaacgtgtggctttgtggtttttaaatgttggtgaataaagatgtttcctttggattaactagtatttttcctattggtttcatggttttagcacacaacattttaaatatgctgttagatgatatgctgcctgctttattatttacttacccctcaccttcagtttcaaagttgttgcaatgactctgtgtagtttaagatcgagtgaaagtagattttgtctatatttattaggggtatttgatatgctaatggtaaacatggtttatgacagcgtacttttttggttatggtgttgacgtttccttttaaacattatagtagcgtccttggtctgtgttcattggttgaacaaaggcacactcacttggagatgccgtctccactgatatttgaacaaagaattcggtac

SEQ ID NO: 164 - protein, 493 aa, Artificial Sequence; identical to SEQ ID NO: 151
  Apo18

SEQ ID NO: 165 - DNA, 3043 bp, Artificial Sequence
  Apo19
aattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcatttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagccaaggctacgggcgatccacccatgaacttccttaagtctttccctttctacgctttcctttgtttcggtcaatacttcgttgctgttacgcatgccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcaggtcgaccgaatgagttccaagatggtttgtgacgaagttagttggttgtttttatggaactttgtttaagctagcttgtaatgtggaaagaacgtgtggctttgtggtttttaaatgttggtgaataaagatgtttcctttggattaactagtatttttcctattggtttcatggttttagcacacaacattttaaatatgctgttagatgatatgctgcctgctttattatttacttacccctcaccttcagtttcaaagttgttgcaatgactctgtgtagtttaagatcgagtgaaagtagattttgtctatatttattaggggtatttgatatgctaatggtaaacatggtttatgacagcgtacttttttggttatggtgttgacgtttccttttaaacattatagtagcgtccttggtctgtgttcattggttgaacaaaggcacactcacttggagatgccgtctccactgatatttgaacaa

SEQ ID NO: 166 - protein, 511 aa, Artificial Sequence; identical to SEQ ID NO: 158
  Apo19

SEQ ID NO: 167 - DNA, 31 bp, Artificial Sequence
  forward primer 1177
gcagcattcatgaacttccttaagtctttcc

SEQ ID NO: 168 - DNA, 35 bp, Artificial Sequence
  reverse primer 1178
ggtggtggatcccctgggtgttgagcttcttagtg

SEQ ID NO: 169 - DNA, 3059 bp, Artificial Sequence
  Apo20
gaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcatttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagccaaggctacgggcgatccacccatgaacttccttaagtctttccctttctacgctttcctttgtttcggtcaatacttcgttgctgttacgcatgccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccaggggatccccttggctagtaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccttggccaacacttgtcactactttctcttatggtgttcaatgcttttcaagatacccagatcatatgaagcggcacgacttcttcaagagcgccatgcctgagggatacgtgcaggagaggaccatctctttcaaggacgacgggaactacaagacacgtgctgaagtcaagtttgagggagacaccctcgtcaacaggatcgagcttaagggaatcgatttcaaggaggacggaaacatcctcggccacaagttggaatacaactacaactcccacaacgtatacatcacggcagacaaacaaaagaatggaatcaaagctaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataagtcatgactgcaggtcgaccgaatgagttccaagatggtttgtgacgaagttagttggttgtttttatggaactttgtttaagctagcttgtaatgtggaaagaacgtgtggctttgtggtttttaaatgttggtgaataaagatgtttcctttggattaactagtatttttcctattggtttcatggttttagcacacaacattttaaatatgctgttagatgatatgctgcctgctttattatttacttacccctcaccttcagtttcaaagttgttgcaatgactctgtgtagtttaagatcgagtgaaagtagattttgtctatatttattaggggtatttgatatgctaatggtaaacatggtttatgacagcgtacttttttggttatggtgttgacgtttccttttaaacattatagtagcgtccttggtctgtgttcattggttgaacaaaggcacactcacttggagatgccgtctccactgatatttgaacaa

SEQ ID NO: 170 - protein, 518 aa, Artificial Sequence; identical to SEQ ID NO: 160
  Apo20

SEQ ID NO: 171 - DNA, 3510 bp, Artificial Sequence
  Apo21
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 172 - protein, 244 aa, Artificial Sequence
  Apo21
MDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 173 - DNA, 34 bp, Artificial Sequence
  forward primer 1203
gcagcaccatggatgaacccccccagagcccctg

SEQ ID NO: 174 - DNA, 52 bp, Artificial Sequence
  forward primer 1206
gtggtgaagctttcactgggtgttgagcttcttagtgtactcctccagagcg

SEQ ID NO: 175 - DNA, 3531 bp, Artificial Sequence
  Apo22
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 176 - protein, 251 aa, Artificial Sequence
  Apo22
MGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 177 - DNA, 36 bp, Artificial Sequence
  forward primer 1201
gcagcaccatggggcggcatttctggcagcaagatg

SEQ ID NO: 178 - DNA, 4269 bp, Artificial Sequence
  Apo23
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 179 - protein, 417 aa, Artificial Sequence
  Apo23
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 180 - DNA, 4290 bp, Artificial Sequence
  Apo24
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 181 - protein, 424 aa, Artificial Sequence
  Apo24
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 182 - DNA, 4389 bp, Artificial Sequence
  Apo25
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggctgagatcacccgcattcctctctacaaaggtaagtctctccgtaaggcgctgaaggaacatggacttctagaagacttcttgcagaaacaacagtatggcatctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 183 - protein, 457 aa, Artificial Sequence
  Apo25
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMAEITRIPLYKGKSLRKALKEHGLLEDFLQKQQYGISSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 184 - DNA, 4410 bp, Artificial Sequence
  Apo26
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggctgagatcacccgcattcctctctacaaaggtaagtctctccgtaaggcgctgaaggaacatggacttctagaagacttcttgcagaaacaacagtatggcatctcgagcaagttcatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 185 - protein, 464 aa, Artificial Sequence
  Apo26
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMAEITRIPLYKGKSLRKALKEHGLLEDFLQKQQYGISSKFMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 186 - DNA, 4386 bp, Artificial Sequence
  Apo27
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggctgagatcacccgcattcctctctacaaaggtaagtctctccgtaaggcgctgaaggaacatggacttctagaagacttcttgcagaaacaacagtatggcatctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 187 - protein, 456 aa, Artificial Sequence
  Apo27
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMAEITRIPLYKGKSLRKALKEHGLLEDFLQKQQYGISSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 188 - DNA, 39 bp, Artificial Sequence
  forward primer 1200
gcagcactcgagcaagttccggcatttctggcagcaaga

SEQ ID NO: 189 - DNA, 1611 bp, Artificial Sequence
  Apo27M
atggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggctgagatcacccgcattcctctctacaaaggtaagtctctccgtaaggcgctgaaggaacatggacttctagaagacttcttgcagaaacaacagtatggcatctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagtgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtga

SEQ ID NO: 190 - protein, 456 aa, Artificial Sequence
  Apo27M
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMAEITRIPLYKGKSLRKALKEHGLLEDFLQKQQYGISSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQCLAARLEALKENGGARLAEYHAKATEHLSTLSEKAKPALEDLRQGLLPVLESFKVSFLSALEEYTKKLNTQ

SEQ ID NO: 191 - DNA, 39 bp, Artificial Sequence
  forward primer 1202
gcagcactcgagcaagttcgatgaacccccccagagccc

SEQ ID NO: 192 - DNA, 25 bp, Artificial Sequence
  forward primer 1225
cgccagtgcttggccgcgcgccttg

SEQ ID NO: 193 - DNA, 4404 bp, Artificial Sequence
  Apo28
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctactatggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtaagcacacatttatcatcttacttcataattttgtgcaatatgtgcatgcatgtgttgagccagtagctttggatcaatttttttggtagaataacaaatgtaacaataagaaattgcaaattctagggaacatttggttaactaaatacgaaatttgacctagctagcttgaatgtgtctgtgtatatcatctatataggtaaaatgcttggtatgatacctattgattgtgaataggtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactaccatggctgagatcacccgcattcctctctacaaaggtaagtctctccgtaaggcgctgaaggaacatggacttctagaagacttcttgcagaaacaacagtatggcatctcgagcaagttccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 194 - protein, 462 aa, Artificial Sequence
  Apo28
MADTARGTHHDIIGRDQYPMMGRDRDQYQMSGRGSDYSKSRQIAKAATAVTAGGSLLVLSSLTLVGTVIALTVATPLLVIFSPILVPALITVALLITGFLSSGGFGIAAITVFSWIYKYATGEHPQGSDKLDSARMKLGSKAQDLKDRAQYYGQQHTGGEHDRDRTRGGQHTTMAEITRIPLYKGKSLRKALKEHGLLEDFLQKQQYGISSKFRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 195 - DNA, 25 bp, Artificial Sequence
  forward primer 1205
ccaagcccgcgctagaggacctccg

SEQ ID NO: 196 - DNA, 3585 bp, Artificial Sequence
  Apo29
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgccatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 197 - protein, 269 aa, Artificial Sequence
  Apo29
MNFLKSFPFYAFLCFGQYFVAVTHAMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 198 - DNA, 3606 bp, Artificial Sequence
  Apo30
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgccatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 199 - protein, 276 aa, Artificial Sequence
  Apo30
MNFLKSFPFYAFLCFGQYFVAVTHAMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 200 - DNA, 4332 bp, Artificial Sequence
  Apo31
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 201 - protein, 518 aa, Artificial Sequence
  Apo31
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 202 - DNA, 4350 bp, Artificial Sequence
  Apo32
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 203 - protein, 524 aa, Artificial Sequence
  Apo32
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 204 - DNA, 4335 bp, Artificial Sequence
  Apo33
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 205 - protein, 519 aa, Artificial Sequence
  Apo33
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 206 - DNA, 4356 bp, Artificial Sequence
  Apo34
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 207 - protein, 526 aa, Artificial Sequence
  Apo34
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 208 - DNA, 4344 bp, Artificial Sequence
  Apo35
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 209 - protein, 522 aa, Artificial Sequence
  Apo35
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 210 - DNA, 41 bp, Artificial Sequence
  reverse primer 1208
aagctttcatagctcatctttctgggtgttgagcttcttag

SEQ ID NO: 211 - DNA, 4362 bp, Artificial Sequence
  Apo36
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 212 - protein, 528 aa, Artificial Sequence
  Apo36
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 213 - DNA, 4347 bp, Artificial Sequence
  Apo37
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 214 - protein, 523 aa, Artificial Sequence
  Apo37
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 215 - DNA, 4368 bp, Artificial Sequence
  Apo38
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgagcaagttcatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 216 - protein, 530 aa, Artificial Sequence
  Apo38
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSSKFMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 217 - DNA, 4446 bp, Artificial Sequence
  Apo39
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 218 - protein, 556 aa, Artificial Sequence
  Apo39
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 219 - DNA, 35 bp, Artificial Sequence
  forward primer 1207
gcagcagtcgactatggctgagatcacccgcattc

SEQ ID NO: 220 - DNA, 4464 bp, Artificial Sequence
  Apo40
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 221 - protein, 562 aa, Artificial Sequence
  Apo40
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 222 - DNA, 4449 bp, Artificial Sequence
  Apo41
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 223 - protein, 557 aa, Artificial Sequence
  Apo41
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 224 - DNA, 4470 bp, Artificial Sequence
  Apo42
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctggaggagtacactaagaagctcaacacccagtgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 225 - protein, 564 aa, Artificial Sequence
  Apo42
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 226 - DNA, 4458 bp, Artificial Sequence
  Apo43
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 227 - protein, 560 aa, Artificial Sequence
  Apo43
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 228 - DNA, 4476 bp, Artificial Sequence
  Apo44
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctagaggacctccgccaaggcctgctgcccgtgctggagagcttcaaggtcagcttcctgagcgctctggaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 229 - protein, 566 aa, Artificial Sequence
  Apo44
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 230 - DNA, 4461 bp, Artificial Sequence
  Apo45
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 231 - protein, 561 aa, Artificial Sequence
  Apo45
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 232 - DNA, 4482 bp, Artificial Sequence
  Apo46
gaattcattgtactcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataaagatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatcatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataacatttatggtggactaattttcatatatttcttattgcttttaccttttcttggtatgtaagtccgtaactagaattacagtgggttgccatgacactctgtggtcttttggttcatgcatgggtcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaccatgaacttccttaagtctttccctttctacgctttcctttgtttcggtcaatacttcgttgctgttacgcatgctgacattgtgatgacacagtctccatcctccctggctatgtcagtgggacagcgggtcactatgcgctgcaagtccagtcagagccttttaaaaagtaccaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattataacactcctcccacgttcggtgctgggaccaagctggagcttaagcggtctccgaacggtgcttctcatagcggttctgcaccaggcactagctctgcatctggatctcaggtgcacctgcagcagtctggagctgagctgatgaagcctggggcctcaatgaagatatcctgcaaggctactggctacacattcagtagctactggatagagtgggtaaagcagaggcctggacatggccttgagtggattggagagattttacctggcagtggtagtactacctacaatgagaagttcaagggcaaggccacattcactgcagatacatcctccaacacagcctacatgcaactcagcagcctgacatctgaggactctgccgtctattactgtgcaagattggatgttgactcctggggccaaggcaccactctcacagtctcgactatggctgagatcacccgcattcctctctacaaaggtaagtctctccgtaaggcgctgaaggaacatggacttctagaagacttcttgcagaaacaacagtatggcatctcgagcaagttcatggggcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagaaagatgagctatgaaagcttaaataagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaactaa

SEQ ID NO: 233 - protein, 568 aa, Artificial Sequence
  Apo46
MNFLKSFPFYAFLCFGQYFVAVTHADIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSTMAEITRIPLYKGKSLRKALKEHGLLEDFLQKQQYGISSKFMGRHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQKDEL

SEQ ID NO: 234 - DNA, 1329 bp, Artificial Sequence
  Apo47
atggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtctaagcttatggctgagatcacccgcattcctctctacaaaggtaagtctctccgtaaggcgctgaaggaacatggacttctagaagacttcttgcagaaacaacagtatggcatctcgagcaagttcatggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtga

SEQ ID NO: 235 - protein, 442 aa, Artificial Sequence
  Apo47
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPGADQLDHAKARLASKARDIKDAAQHRIDQAQGSKLMAEITRIPLYKGKSLRKALKEHGLLEDFLQKQQYGISSKFMDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 236 - DNA, 25 bp, Artificial Sequence
  forward primer 1226
gcagcaccatggctgatcaccaccg

SEQ ID NO: 237 - DNA, 25 bp, Artificial Sequence
  forward primer 1227
gtggtgaagcttagacccctgcgcc

SEQ ID NO: 238 - DNA, 26 bp, Artificial Sequence
  forward primer 1228
gcagcaaagcttatggctgagatcac

SEQ ID NO: 239 - DNA, 24 bp, Artificial Sequence
  reverse primer 1229
gtgtgggatcctcactgggtgttg

SEQ ID NO: 240 - protein, 248 aa, Artificial Sequence
  D9 scFV
DIVMTQSPSSLAMSVGQRVTMRCKSSQSLLKSTNQKNYLAWYQQKPGQSPKLLVYFASTRESGVPDRFIGSGSGTDFTLTISSVQAEDLADYFCQQHYNTPPTFGAGTKLELKRSPNGASHSGSAPGTSSASGSQVHLQQSGAELMKPGASMKISCKATGYTFSSYWIEWVKQRPGHGLEWIGEILPGSGSTTYNEKFKGKATFTADTSSNTAYMQLSSLTSEDSAVYYCARLDVDSWGQGTTLTVSS

SEQ ID NO: 241 - protein, 368 aa, Mus musculus
MAAVITWALALLAVFASTQARKSLWDYFSQNSWSKGVMGQPQKLAQENLKGSFEQDLYNMNNYLEKLGPLRGPGKEPPLLAQDPEGIRKQLQQELGEVSSRLEPYMAAKHQQVGWNLEGLRQQLKPYTAELMEQVGLSVQELQEQLRVVGEDTKAQLLGGVDEALNLLQDMQSRVLHHTDRVKELFHPYAERLVTGIGHHVQELHRSVAPHAAASPARLSRCVQTLSHKLTRKAKDLHTSIQRNLDQLRDELSAFIRVSTDGAEDGDSLDPQALSEEVRQRLQAFRHDTYLQIAAFTQAIDQETEEIQHQLAPPPPSHSAFAPELGHSDSNKALSRLQSRLDDLWEDIAYGLQDQGHSHLSDPEGHSG

SEQ ID NO: 242 - protein, 367 aa, Rattus norvegicus
MAAVITWALALLSVFATVQARKSFWEYFGQNSQGKGMMGQQQKLAQESLKGSLEQDLYNMNNFLEKLGPLREPGKEPPRLAQDPEGIRKQLQQELEEVSTRLEPYMAAKHQQVGWNLEGLRQQLKPYTVELMEQVGLSVQDLQEQLRMVGKGTKAQLLGGVDEAMSLLQDMQSRVLHHTDRVKELFHPYAERLVTGIGHHVQELHRSVAPHAVASPARLSRCVQTLSHKLTRKAKDLHTSIQRNLDQLRDELSTFIRVSTDGADNRDSLDPQALSDEVRQRLQAFRHDTYLQIAAFTQAIDQETEEIQHQLAPPPPSHSAFAPELGHSDSNKALSRLQSRLDDLWEDIAYGLHDQGHSQNNPEGHSG

SEQ ID NO: 243 - protein, 363 aa, Homo sapiens
MAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 244 - protein, 368 aa, Mus musculus
MAAVITWALALLAVFASTQARKSLWDYFSQNSWSKGVMGQPQKLAQENLKGSFEQDLYNMNNYLEKLGPLRGPGKEPPLLAQDPEGIRKQLQQELGEVSSRLEPYMAAKHQQVGWNLEGLRQQLKPYTAELMEQVGLSVQELQEQLRVVGEDTKAQLLGGVDEALNLLQDMQSRVLHQADRVKELFHPYAERLVTGIGHHVQELHRSVAPHAAASPARLSRCVQTLSHKLTRKAKDLHTSIQRNLDQLRDELSAFIRVSTDGAEDGDSLDPQALSEELRQRLQAFRHDTYLQIAAFTQAIDQETEEIQHQLAPPPPSHSAFAPELGHSDSNKALSRLQSRLDDLWEDIAYGLQDQGHSHLSDPEGHSG

SEQ ID NO: 245 - protein, 366 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 246 - protein, 366 aa, Homo sapiens; identical to SEQ ID NO: 245

SEQ ID NO: 247 - protein, 368 aa, Mus musculus
MAAVITWALALLAVFASTQARKSLWDYFSQNSWSKGVMGQPQKLAQENLKGSFEQDLYNMNNYLEKLGPLRGPGKEPPLLAQDPEDIRKQLQQELGEVSSRLEPYMAAKHQQVGWNLEGLRQQLKPYTAELMEQVGLSVQELQEQLRVVGEDTKAQLLGGVDEALNLLQDMQSRVLHHTDRVKELFHPYAERLVTGIGHHVQELHRSVAPHAAASPARLSRCVQTLSHKLTRKAKDLHTSIQRNLDQLRDELSAFIRVSTDGAEDGDSLDPQALSEEVRQRLQAFRHDTYLQIAAFTQAIDQETEEIQHQLAPPPPSHSAFAPELGHSDSNKALSRLQSRLDDLWEDIAYGLQDQGHSHLSDPEGHSG

SEQ ID NO: 248 - protein, 363 aa, Homo sapiens; identical to SEQ ID NO: 243

SEQ ID NO: 249 - protein, 363 aa, Homo sapiens; identical to SEQ ID NO: 243

SEQ ID NO: 250 - protein, 367 aa, Rattus norvegicus; identical to SEQ ID NO: 242

SEQ ID NO: 251 - protein, 367 aa, Rattus norvegicus; identical to SEQ ID NO: 242

What we claim as our invention is:

1. A method for the expression of apolipoprotein in plants, comprising:
   (a) providing a chimeric nucleic acid construct comprising, as operably linked components: (i) a seed-preferred promoter and (ii) a nucleic acid sequence encoding a fusion polypeptide that comprises a primary sequence that is comprised of an apolipoprotein sequence that is joined to a first partner sequence that is either (1) an oil body protein or (2) a partner comprised of a signal peptide and a stabilizing polypeptide selected from the group consisting of thioredoxin, GFP, and a single chain antibody;
   (b) introducing the chimeric nucleic acid construct into a plant cell under nuclear genomic integration conditions; and then
   (c) growing the plant cell into a mature plant wherein seed of the plant expresses said fusion polypeptide.

2. A method according to claim 1, wherein said first partner sequence is (2) and said primary sequence is joined, at its C-terminus, to a targeting signal comprised of an ER-retention motif.

3. A method according to claim 1, wherein said first partner sequence is (1).

4. A method according to claim 1 or 2, wherein said first partner sequence is (2).

5. A method according to claim 1, wherein the seed-preferred promoter is a phaseolin promoter.

6. A method according to claim 3, wherein said oil body protein is selected from the group consisting of oleosin, caleosin, and steroleosin.

7. A method according to claim 6, wherein said oleosin, caleosin, and steroleosin are from *Arabidopsis thaliana*.

8. A method according to claim 4, wherein said stabilizing polypeptide is encoded by a nucleic segment that is codon-optimized for expression in plants.

9. A method according to claim 4, wherein said stabilizing polypeptide is a single-chain antibody expressed in seeds.

10. A method according to claim 9, wherein said single-chain antibody is capable of specifically associating with an oil body protein.

11. A method according to claim 10, wherein said single-chain antibody is SEQ ID NO: 240.

12. A method according to claim 1, wherein said first partner sequence is linked to said apolipoprotein sequence via a cleavable linker.

13. A method according to claim 12, wherein said cleavable linker is a chymosin pro-sequence.

14. A method according to claim 13, wherein said chymosin pro-sequence is SEQ ID NO: 143.

15. A method according to claim 1, wherein said apolipoprotein sequence is a mature apolipoprotein sequence.

16. A method according to claim 1, wherein said apolipoprotein sequence is joined-at the N-terminus to said first partner.

* * * * *